United States Patent
Sette et al.

(10) Patent No.: US 10,428,124 B2
(45) Date of Patent: Oct. 1, 2019

(54) TIMOTHY GRASS ALLERGENS AND METHODS AND USES FOR IMMUNE RESPONSE MODULATION

(71) Applicant: LA JOLLA INSTITUTE FOR ALLERGY AND IMMUNOLOGY, San Diego, CA (US)

(72) Inventors: Alessandro Sette, La Jolla, CA (US); Veronique Schulten, San Diego, CA (US); Howard Grey, La Jolla, CA (US); Bjoern Peters, San Diego, CA (US); Jason Greenbaum, San Diego, CA (US)

(73) Assignee: La Jolla Institute For Allergy And Immunology, San Diego, CA (US)

( * ) Notice: Subject to any disclaimer, the term of this patent is extended or adjusted under 35 U.S.C. 154(b) by 451 days.

(21) Appl. No.: 14/375,980

(22) PCT Filed: Feb. 7, 2013

(86) PCT No.: PCT/US2013/025213
§ 371 (c)(1),
(2) Date: Jul. 31, 2014

(87) PCT Pub. No.: WO2013/119863
PCT Pub. Date: Aug. 15, 2013

(65) Prior Publication Data
US 2015/0023992 A1    Jan. 22, 2015

Related U.S. Application Data

(60) Provisional application No. 61/596,156, filed on Feb. 7, 2012, provisional application No. 61/734,886, filed on Dec. 7, 2012.

(51) Int. Cl.
| | | |
|---|---|---|
| C07K 14/415 | (2006.01) | |
| A61K 39/36 | (2006.01) | |
| A61K 39/00 | (2006.01) | |
| A61K 38/00 | (2006.01) | |

(52) U.S. Cl.
CPC .......... C07K 14/415 (2013.01); A61K 39/36 (2013.01); *A61K 38/00* (2013.01); *A61K 2039/543* (2013.01); *A61K 2039/55505* (2013.01)

(58) Field of Classification Search
None
See application file for complete search history.

(56) References Cited

U.S. PATENT DOCUMENTS

| | | | |
|---|---|---|---|
| 2007/0044171 A1* | 2/2007 | Kovalic | C07K 14/415 |
| | | | 800/278 |
| 2008/0193535 A1 | 8/2008 | Jacobi et al. | |
| 2009/0070897 A1 | 3/2009 | Goldman et al. | |
| 2011/0097361 A1 | 4/2011 | Tang | |
| 2011/0217325 A1 | 9/2011 | O'Hehir et al. | |
| 2011/0293665 A1 | 12/2011 | Bordas et al. | |
| 2012/0100163 A1 | 4/2012 | Brimnes et al. | |
| 2012/0100164 A1 | 4/2012 | Brimnes et al. | |

FOREIGN PATENT DOCUMENTS

| | | |
|---|---|---|
| WO | WO2004/000881 A1 | 12/2003 |
| WO | WO 2004/022588 A1 | 3/2004 |
| WO | WO 2006/076423 A2 | 7/2006 |
| WO | WO 2013/148325 A1 | 10/2013 |
| WO | WO 2013/156467 A1 | 10/2013 |

OTHER PUBLICATIONS

Schulten et al. Previously undescribed grass pollen antigens are the major inducers of T helper 2 cytokine-producing T cells in allergic individuals. PNAS 110(21):3459-3464, 2013.*
Candia et al. On Peptides and Altered Peptide Ligands: From Origin, Mode of Action and Design to Clinical Application (Immunotherapy). Int. Arch. Allerg. Immunol. 170:211-233, 2016.*
Abaza et al. J. Prot. Chem. 11(5):433-444, 1992.*
Schulten, V., et al., "Previously undescribed grass pollen antigens are the major inducers of T. helper 2 cytokine-producing T cells in allergic individuals," *Proceedings of the National Academy of Sciences of the United States of America*, Feb. 26, 2013, pp. 3459-3464, vol. 110 (9).
Till, S., et al., "IL-5 production by allergen-stimulated T Cells following grass pollen immunotherapy for seasonal allergic rhinitis," *Clin Exp Immunol*, 1997, vol. 110, pp. 114-121.
Vrtala, S., et al al., Molecular, Immunological, and Structural Characterization of Phl p 6, a Major Allergen and P-Particle-Associated Protein from Timothy Grass (*Phleum pretense*) Pollen, *The Journal of Immunology*, 1999, vol. 163(10), pp. 5489-5496.
Würtzen, P., et al., "Identification of isoform-specific T-cell epitopes in the major timothy grass pollen allergen, Phl p 5," *Clincal and Experimental Allergy*, 1999, vol. 29, pp. 1614-1625.
Corti, V., et al., "Identification of grass pollen allergens by two-dimensional gel electrophoresis and serological screening," *Proteonomics*, 2005, vol. 5(3), pp. 729-836.
Database UniProt K6Z7G9, "SubName: Full=Uncharacterized protein (ECO:0000313; EMBL: JAA00391.1)," 2013, 1 page.
Kay, A.B., "Overview of 'Allergy and allergic disease: with a view to the future,'" *British Medical Bulletin*, 2000, vol. 56(4), pp. 843-864.

(Continued)

*Primary Examiner* — Nora M Rooney
(74) *Attorney, Agent, or Firm* — Womble, Bond Dickinson (US) LLP

(57) ABSTRACT

The invention relates to Timothy Grass proteins and peptides, subsequences, portions, homologs, variants and derivatives thereof, and methods and uses of Timothy Grass proteins and peptides. Methods include, for example, modulating an immune response; protecting a subject against or treating a subject for an allergic response, allergic disorder or allergic disease; and inducing immunological tolerance to the allergen in a subject.

5 Claims, 6 Drawing Sheets

Specification includes a Sequence Listing.

(56) References Cited

OTHER PUBLICATIONS

Persson, H., et al., "A common idiotype in IgE and its relation to recognition of the grass pollen allergen Phl p 2," *Molecular Immunology*, 2008, vol. 45, pp. 2715-2720.
Schulten, V., et al., "Association between specific timothy grass antigens and changes in TH1- and TH2-cell responses following specific immunotherapy," *J Allergy Clin Immunol*, 2014, vol. 134(5), pp. 1076-1083.
Rossi, R. E., et al. "Evaluation of IgE Antibodies to Recombinant Pollen Allergens (Phl p 1, Phl p 2 and Phl p 5) in a Random Sample of Patients with Specific IgE to *Phleum pratense*," *Allergy*, 2000, pp. 181-184, vol. 55.
Vrtala, S., et al. "cDNA Cloning of a Major Allergen from Timothy Grass (*Phleum pratense*) Pollen; Characterization of the Recombinant Phl p V Allergen," *The Journal of Immunology*, 1993, pp. 4773-4781, vol. 151.
Brozek, J.L., et al. "Allergic Rhinitis and its Impact on Asthma (ARIA) guidelines: 2010 revision," *J Allergy Clin Immunol*, 2010, 126(3):466-476.
Cady, C.T., et al., "IgG antibodies produced during subcutaneous allergen immunotherapy mediate inhibition of basophil activation via a mechanism involving both FcgammaRIIA and FcgammaRIIB," *Immunol Lett*, 2010, 130(1-2):57-65.
Chain, B.M., et al., "Antigen processing: current issues, exceptional cases (Thy 1 alloantigen, MHC class-II-restricted cytolytic T cells), and implications for vaccine development," *J Autoimmun*, 1989, 2 Suppl 1:45-53.
Chapman, M.D., "Allergen nomenclature," *Clin Allergy Immunol*, 2008, 21:47-58.
Chen, C., et al., "Identification of CD4+ T cell epitopes in C. burnetii antigens targeted by antibody responses," *PLoS One*, 2011, 6(3):e17712.
Gieras, A., et al., "Molecular determinants of allergen-induced effector cell degranulation," *J Allergy Clin Immunol*, 2007, 119(2):384-390.
Lanzavecchia, A., "Antigen-specific interaction between T and B cells," *Nature*, 1985, 314(6011):537-539.
Laprise, C. & L.P. Boulet, "Airway responsiveness and atopy in families of patients with asthma," *Clin Invest Med*, 1996, 19(6):461-469.
Lowenstein, H., "Quantitative immunoelectrophoretic methods as a tool for the analysis and isolation of allergens," *Prog Allergy*, 1978, 25:1-62.
Mehlhop, P.D., et al., "Allergen-induced bronchial hyperreactivity and eosinophilic inflammation occur in the absence of IgE in a mouse model of asthma," *Proc Natl Acad Sci USA*, 1997, 94(4):1344-1349.
Nathan, R.A., "The burden of allergic rhinitis," *Allergy Asthma Proc*, 2007, 28(1):3-9.
Oseroff, C., et al., "Analysis of T Cell Responses to the Major Allergens from German Cockroach: Epitope Specificity and Relationship to IgE Production," *J Immunol*, 2012, 189(2):679-688.
Oseroff, C., et al., "Molecular determinants of T cell epitope recognition to the common Timothy grass allergen," *J Immunol*, 2010, 185(2):943-955.
Oseroff, C., et al., "T Cell Responses to Known Allergen Proteins Are Differently Polarized and Account for a Variable Fraction of Total Response to Allergen Extracts," *J Immunol*, 2012, 189:1800-1811.

Petersen, A., et al., "Post-translational modifications influence IgE reactivity to the major allergen Phl p 1 of timothy grass pollen," *Clin Exp Allergy*, 1998, 28(3):315-321.
Rolland, J.M., et al., "Allergen immunotherapy: current and new therapeutic strategies," *Expert Opin Investig Drugs*, 2000, 9(3):515-527.
Romagnani, S., "The role of lymphocytes in allergic disease," *J Allergy Clin Immunol*, 2000, 105(3):399-408.
Schuhbauer, D.M., et al., "Interaction within clusters of dendritic cells and helper T cells during initial Th1/Th2 commitment," *Eur J Inununol*, 2000, 30(5):1255-1262.
Sette, A., et al., "Selective CD4+ T cell help for antibody responses to a large viral pathogen: deterministic linkage of specificities," *Immunity*, 2008, 28(6):847-858.
Skripak, J.M., et al,. "A randomized, double-blind, placebo-controlled study of milk oral immunotherapy for cow's milk allergy," *J Allergy Clin Immunol*, 2008, 122(6):1154-1160.
Surget-Groba, Y. & J.I. Montoya Burgos, "Optimization of de novo transcriptome assembly from next-generation sequencing data," *Genome Res*, 2010, 20(10):1432-1440.1.
Terada, T. et al., "A chimeric human-cat Fcgamma-Fel d1 fusion protein inhibits systemic, pulmonary, and cutaneous allergic reactivity to intratracheal challenge in mice sensitized to Fel d1, the major cat allergen," *Clin Immunol*, 2006, 120(1):45-46.
Vijayanand, P., et al., "Interleukin-4 production by follicular helper T cells requires the conserved Il4 enhancer hypersensitivity site V," *Immunity*, 2012, 36(2):175-187.
Wachholz, P.A. & S.R. Durham, "Mechanisms of immunotherapy: IgG revisited," *Curr Opin Allergy Clin Immunol*, 2004, 4(4):313-318.
Wallner, M., et al., "Immunologic characterization of isoforms of Car b 1 and Que a 1, the major hornbeam and oak pollen allergens," *Allergy*, 2009, 64(3):452-460.
Wang, P., et al., "A systematic assessment of MHC class II peptide binding predictions and evaluation of a consensus approach," *PLoS Comput Biol*, 2008, 4(4):e1000048.
Wang, P., et al., "Peptide binding predictions for HLA DR, DP and DQ molecules," *BMC Bioinformatics*, 2010, 11:568.
Wurtzen, P.A., et al., "Dissection of the grass allergen-specific immune response in patients with allergies and control subjects: T-cell proliferation in patients does not correlate with specific serum IgE and skin reactivity," *J Allergy Clin Immunol*, 1998, 101(2 Pt 1):241-249.
Zerbino, D.R. & E. Birney, "Velvet: algorithms for de novo short read assembly using de Bruijn graphs," *Genome Res*, 2008, 18(5):821-829.
International Search Report for Patent Application No. PCT/US2013/025213 dated Jun. 18, 2013.
Uniprot Direct Submission. Q7XAS6_CYNDA. Proteomics and immunological analyses of a novel allergen, Cyn d 22, from Bermuda grass pollen. (Dec. 14, 2011) [Retrieved from the Internet Jun. 7, 2013: <http://www.uniprot.org/uniprot/Q7XAS6.txt?version=44>].
Andersson K. & J. Lidholm, "Characteristics and immunobiology of grass pollen allergens," *Int Arch Allergy Immunol*, 2003, 130(2):87-107.
Basketter, D.A. & I. Kimber, "Assessing the potency of respiratory allergens: uncertainties and challenges," *Regul Toxicol Pharmacol*, 2011, 61(3):365-372.
Bauchau, V. & S.R. Durham, "Prevalence and rate of diagnosis of allergic rhinitis in Europe," *Eur Respir J*, 2004, 24(5):758-764.
Benitez, D., et al., "Specific immune response to Phleum pratense plant profilin in atopic patients and control subjects," *Allergol Immunopathol (Madr)*, 2001, 29(1):9-15.

\* cited by examiner

US 10,428,124 B2

TIMOTHY GRASS ALLERGENS AND METHODS AND USES FOR IMMUNE RESPONSE MODULATION

CROSS-REFERENCE TO RELATED APPLICATIONS

This application is the U.S. National Stage of International Application PCT/US2013/025213 filed Feb. 7, 2013, which designates the U.S. and was published by the International Bureau in English on Aug. 15, 2013, and which claims the benefit of U.S. Provisional Application No. 61/596,156, filed Feb. 7, 2012 and U.S. Provisional Application No. 61/734,886, filed Dec. 7, 2012, all of which are hereby incorporated by reference in their entirety.

GOVERNMENT SUPPORT

This invention received government support from the National Institutes Health contract NIH-NIAIDHHSN272200700048C. The government has certain rights in the invention.

SEQUENCE LISTING

The instant application contains a Sequence Listing which has been submitted in ASCII format via EFS-Web and is hereby incorporated by reference in its entirety. Said ASCII copy, created on Feb. 6, 2013, is named 051501-0420334_SL.txt and is 1,444,840 bytes in size.

FIELD OF THE INVENTION

The invention relates to Timothy Grass (TG) proteins and peptides, subsequences, portions, homologues, variants and derivatives thereof, and methods and uses of such proteins and peptides, including methods of modulating an immune response, protecting a subject against or treating a subject for an allergic response, allergic disorder or allergic disease and inducing immunological tolerance to the allergen in a subject.

INTRODUCTION

Allergic diseases such as rhinitis and asthma pose a significant burden to both patients and society as a whole (1). Recent studies have estimated that up to 20% of the population in the US and Western Europe suffers from these diseases, (2, 3). Despite this high incidence, existing therapy is mostly symptomatic, and immunotherapy treatments are successful in only a fraction of patients and can be associated with significant safety concerns (4). Consequently, much effort in allergy research has been devoted to the development of safer and more effective immunological treatments.

T cells play an important role in the pathogenesis of allergic diseases. However, the proteins considered as potential immunogens of allergenic T cell responses have traditionally been limited to those that induce IgE responses. Allergic respiratory diseases are associated with high levels of IgE antibodies to certain allergenic proteins and elevated levels of eosinophils that infiltrate the target tissue (5). Production of Th2 cytokines (IL-4, IL-5 and IL-13; (6)) regulates these events as they are critical for the switch to IgE production by differentiating B cells and promote the influx of eosinophils and other inflammatory cells that contribute to airway pathology.

Despite the importance of Th2 cells and their associated cytokines in the pathogenesis of allergic respiratory disease, studies of antigens considered as triggers of T cell responses have so far been mostly limited to those known to bind IgE antibodies (7, 8) and induce IgE-mediated immediate hypersensitivity reactions (9). Timothy grass (TG) pollen is an inhaled allergen for which major IgE-reactive allergens have been shown to trigger Th2 responses. As disclosed herein, surprisingly Timothy Grass proteins have been discovered that are recognized by Th2 responses independent of IgE-reactivity, including IgG reactive proteins.

SUMMARY

Disclosed herein are novel Timothy Grass (TG) proteins and peptides, as well as methods and uses of such novel Timothy Grass proteins and peptides. Timothy Grass proteins and peptides described include antigens and allergens. Also disclosed herein are Timothy Grass proteins, peptides, subsequences, portions, homologues, variants and derivatives thereof, and methods and uses of such Timothy Grass proteins and peptides.

In accordance with the invention, there are provided proteins and peptides including, consisting of or consisting essentially of an amino acid sequence of a Timothy Grass protein or a subsequence, portion, homologue, variant or derivative thereof. In certain embodiments a Timothy Grass protein comprises, consists of or consists essentially of an amino acid sequence of a protein or peptide set out in Table 1 (SEQ ID NOS 1-620, respectively, in order of appearance), Table 2 (SEQ ID NOS 621-1442, respectively, in order of appearance) Table 4 621-1442 or Table 6, or a subsequence, portion, homologue, variant or derivative thereof. In other embodiments a Timothy Grass protein or peptide does not consist of the sequence set forth in Table 1 as SEQ ID NOs:204, 205, 206, 207, 208, 209, 210, 211, 212, 213, 282, 283, 284, 285, 286, 287, 289, 290, 291, 292, 293, 294, 295, 296, 489, 490 or 491; and/or does not consist of the sequence set forth in Table 4 as SEQ ID NOs:695, 720, 776, 857, 939, 1027, 1028, 1029, 1113, 1218, 1294, 1311, or 1312.

In certain embodiments, a protein or peptide elicits, stimulates, induces, promotes, increases or enhances an anti-allergen immune response. In other certain embodiments, a protein or peptide decreases, reduces, inhibits, suppresses or disrupts an anti-allergen immune response. In particular aspects of the proteins and peptides described herein, an anti-allergen immune response is an anti-Timothy Grass allergen response. In further certain embodiments, a protein or peptide elicits, stimulates, induces, promotes, increases or enhances immunological tolerance (desensitizes) to an allergen, for example, a Timothy Grass allergen such as an amino acid sequence set forth Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof. In certain aspects, an anti-allergen response or immunological tolerance comprises a T cell response, for example a Th2 cell response (e.g., memory T cell response). In particular embodiments a protein or peptide is an IgG antigen.

In different embodiments, a protein or peptide includes, consists of or consists essentially of an amino acid sequence of a protein or peptide with open reading frame identification M.693, M.692, M.125, M.714, M.721, M.705, M.591, M.418, M.689, M.644, M.414, M.624, M.617, M.704, M.331, M.604, M.291, M.151, M.498, M.561, M.399, M.603, M.226, M.636, M.473, M.437, M.634, M.676, M.422, M.431, M.387, M.722, M.610, M.574, M.531, M.305, M.282, M.271, M.159, M.83, M.348, M.285, M.288, M.287, M.212, M.715, M.725, M.694, M.701, M.595, M.718, M.720, M.723, M.648, M.662, M.576, M.618, M.631, M.682, M.421, M.654, M.393, M.669, M.625, M.655, M.524, M.570, M.341, M.342, M.450, M.343, M.639, M.555, M.546, M.606, M.628, M.248, M.466, M.328, M.695, M.658, M.560, M.548, M.269, M.728, M.653, M.759, M.765, M.747, M.763, M.733, M.651, M.677, M.597, M.547, M.761, M.571, M.562, M.657, M.738, M.734, M.621, M.741, M.177, M.579, M.513, M.446, M.388, M.391, M.593, M.506, M.395, M.381, M.372, M.619, M.656, M.525, M.698, M.699, M.439, M.630, M.708, M.620, M.758, M.764, M.746, M.762, M.716, M.726, MN.66, M.717, M.727, M.719, M.724, M.577, M.8, M.235, M.678, M.675, M.641, M.499, M.583, M.649, M.6, M.29, M.34, M.183, M.101, M.149, M.164, M.129, M.45, M.116, M.165, M.146, M.69, M.123, M.107, M.3, M.113, M.204, M.174, M.178, M.191, M.580, M.587, M.594, M.539, M.569, M.588, M.615, M.578, M.352, M.514, M.419, M.443, M.540, M.640, M.642, M.646, M.627, M.626, M.645, M.652, M.650, M.559, M.622, M.565, M.567, M.581, M.609, M.182, M.134, M.283, M.297, M.367, M.84, M.189, M.586, M.496, M.255, M.471, M.575, M.163, M.314, M.194, M.294, M.472, M.369, M.104, M.206, M.24, M.469, M.420, M.444, M.697, M.687, M.713, M.638, M.673, M.700, M.702, M.707, M.710, M.683, M.670, M.643, M.663, M.664, M.666, M.748, M.731, M.735, M.750, M.752, M.756, M.754, M.608, M.740, M.39, M.303, M.389, M.390, M.284, M.201, M.28, M.364, M.344, M.74, M.180, M.317, M.298, M.192, M.77, M.92, M.144, M.9, M.296, M.187, M.172, M.72, M.38, M.239, M.289, M.240, M.214, M.365, M.614, M.598, M.632, M.633, M.616, M.690, M.607, M.672, M.545, M.671, M.272, M.301, M.202, M.492, M.647, M.457, M.686, M.495, M.486, M.729, M.760, M.668, M.599, M.417, M.635, M.584, M.592, M.709, M.489, M.392, M.347, M.458, M.464, M.415, M.520, M.410, M.467, M.494, M.374, M.118, M.346, M.318, M.519, M.600, M.254, M.438, M.479, M.523, M.380, M.480, M.371, M.482, M.261, M.108, M.260, M.556, M.461, M.400, M.474, M.490, M.491, M.401, M.470, M.409, M.435, M.553, M.537, M.402, M.481, M.483, M.554, M.538, M.234, M.237, M.264, M.563, M.566, M.532, M.557, M.573, M.549, M.550, M.551, M.558, M.463, M.684, M.739, M.637, M.517, M.712, M.732, M.711, M.730, M.736, M.737, M.247, M.13, M.57, M.61, M.47, M.43, M.32, M.518, M.267, M.73, M.270, M.150, M.366, M.679, M.680, M.230, M.530, M.667, M.505, M.488, M.445, M.436, M.508, M.688, M.613, M.487, M.552, M.572, M.336, M.534, M.213, M.384, M.220, M.147, M.127, M.145, M.33, M.110, M.173, M.50, M.249, M.18, M.5, M.25, M.394, M.329, M.330, M.345, M.323, M.316, M.130, M.131, M.203, M.227, M.128, M.70, M.292, M.526, M.585, M.681, M.685, M.596, M.660, M.674, M.703, M.504, M.515, M.521, M.493, M.497, M.509. M.533, M.484, M.302, M.478, M.222, M.691, M.510, M.119, M.535, M.543, M.528, M.529, M.373, M.590, M.361, M.432, M.477, M.408, M.568, M.589, M.462, M.516, M.522, M.412, M.4, M.256, M.56, M.55, M.64, M.22, M.148, M.205, M.332, M.171, ME.3566, ME.4276, ME.4056, ME.3805, ME.3720, ME.3916, ME.3855, ME.1412, ME.4234, ME.4088, ME.4115, ME.4210, ME.3897, ME.4229, ME.4231, ME.4280, ME.4281, ME.1571, ME.4190, ME.4230, ME.3882, MN.82, MN.124, MN.169, MN.185, MN.140, MN.201, MN.193, MN.183. MN.184, MN.173, MN.210, MN.206, MN.136, MN.94, MN.83, MN.14, MN.3, MN.46, MN.17, MN.20, MN.12, MN.35, MN.15, MN.38, MN.74, MN.41, MN.67, MN.27, MN.75, MN.47, MN.33, MN.86, MN.59, MN.8, MN.51, MN.62, MN.56, MN.30, MN.81, MN.91, MN.36, MN.71, MN.80, MN.76, MN.96, MN.106, MN.90, MN.57, MN.25, MN.108, MN.186, MN.58, MN.6, MN.77, MN.107, MN.203, MN.204, MN.211, MN.205, MN.68, MN.98, MN.93, MN.113, MN.123, MN.69, MN.178, MN.182, MN.4, MN.166, MN.167, MN.172, MN.168, MN.105, MN.39, MN.194, MN.195, MN.101, MN.116, MN.181, MN.97, MN.54, MN.156. MN.117, MN.163, MN.175, MN.102, MN.202, MN.157, MN.119, MN.114, MN.92, MN.88, MN.153, MN.95, MN.128, MN.122, MN.118, MN.99, MN.72, MN.214, MN.219, MN.220, MN.199, MN.224, MN.218, MN.215, MN.207, MN.223, MN.221, MN.222, MN.216, MN.162, MN.142, MN.158, MN.141, MN.53, MN.111, MN.112, MN.120, MN.130, MN.132, MN.127, MN.121, MN.139, MN.146, MN.64, MN.87, MN.89, MN.37 or MN.164, or subsequence, portion, homologue, variant or derivative thereof.

As disclosed herein, in certain embodiments proteins and peptides have a length in a range of about 5-10, 10-15, 15-20, 20-25, 25-30, 30-35, 35-40, 45-50, 50-60, 60-70, 70-80, 90-100, 100-125, 125-150, 150-175, 175-200, 200-250, 250-300, or more amino acid residues. In other embodiments, proteins and peptides have a length in a range of up to 25 amino acids in length, or from about 7 to 20; 8 to 30; 8 to 25; 8 to 20; 9 to 30; 9 to 25; 9 to 20; 10 to 30; 10 to 25; 10 to 30 amino acid residues.

Proteins and peptides include isolated and purified forms. Proteins and peptides also include those immobilized on a substrate, as well as amino acid sequences, subsequences, portions, homologues, variants, and derivatives immobilized on a substrate.

Proteins and peptides can be included in compositions, for example, a pharmaceutical composition. In particular embodiments, a pharmaceutical composition is suitable for specific or non-specific immunotherapy, or is a vaccine composition.

Isolated nucleic acid (including isolated nucleic acid) encoding a protein or peptide (TG protein or peptide), or a subsequence, portion, homologue, variant or derivative thereof are provided. In one embodiment, a nucleic acid encodes an amino acid sequence of a protein or peptide set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof.

Also provided are cells expressing a protein or peptide described herein. In various embodiments, a cell expresses a Timothy Grass protein that includes, consists of or consists essentially of an amino acid sequence of a protein or peptide set out in Table 1 (SEQ ID NOS 1-620, respectively, in order of appearance), Table 2 (SEQ ID NOS 621-1442, respectively, in order of appearance) Table 4 (SEQ ID NOS 621-1442, respectively, in order of appearance) or Table 6, or a subsequence, portion, homologue, variant or derivative thereof. In certain aspects, a cell is a eukaryotic or prokaryotic cell and may be a mammalian, insect, fungal or bacterium cell.

Methods and uses and medicaments of proteins and peptides of the invention are included. In various embodiments, there are provided methods and uses of modulating an immune response against an allergen in a subject. In one embodiment, a method or use includes administering (delivering) an allergen to a subject an amount of the protein described herein sufficient to modulate the immune response against the allergen in the subject.

Such methods, uses and medicaments also include modulating immune activity of a cell against an allergen; and desensitizing, inducing, eliciting, increasing or improving in the cell immunological tolerance to an allergen. In particular embodiments, a method or use includes contacting a cell with an amount of the protein or peptide of any one of the above-mentioned embodiments, sufficient to modulate the immune activity of the cell against the allergen (e.g., against an allergen from which the peptide or protein derives), or administering to a subject an allergen from which the peptide or protein derives in order to desensitize, induce, elicit, increase or improve immunological tolerance to the allergen or to modulate an immune response against an allergen in a subject (e.g., an allergen from which the peptide or protein derives).

Invention proteins, peptides, subsequences, portions, homologues, variants and derivatives thereof are suitable as a reagent for example, for specific immunotherapy. In particular embodiments, a protein or peptide suitable as a reagent includes, consists of or consists essentially of an amino acid sequence of a protein or peptide set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof.

Such methods, uses and medicaments further include reducing risk or providing a subject protection against an allergic reaction, allergic response, allergic disorder or allergic disease. In one embodiment, a method or use includes administering to the subject an amount of the protein or peptide sufficient to reduce risk or provide the subject with protection against the allergic reaction, allergic response, allergic disorder or allergic disease. Non-limiting examples of an allergic reaction or allergic response include allergic alveolitis, allergic bronchopulmonary aspergillosis, allergic conjunctivitis, allergic coryza, allergic dermatitis, allergic vasculitis, and allergic rhinitis.

Such methods, uses and medicaments additionally include treating an allergic reaction, allergic response, allergic disorder or allergic disease. In one embodiment, a method or use includes administering to the subject an amount of the protein or peptide, sufficient to treat the subject for the allergic response, allergic disorder or allergic disease.

In such methods, uses and medicaments, a peptide or protein can be derived from or based upon the allegen or can be derived from or based upon an allergen originating from the same organism as the allergen. More particularly, for example, a protein or peptide can be derived from or based upon an allergen causing the allergic reaction, allergic response, allergic disorder or allergic disease or said peptide derives from an allergen belonging to the same organism as the allergen causing said allergic reaction, allergic response, allergic disorder or allergic disease. Additionally, for example, a protein or peptide can be based upon or derived from an amino acid sequence set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof.

In various embodiments, a method or use desensitizes or induces, elicits, increases or improves immunological tolerance of a subject to an allergen in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6. In various other embodiments, a method or use desensitizes or induces, elicits, increases or improves immunological tolerance of a subject to an amino acid sequence set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof.

As set forth herein a protein, peptide, method, use or medicament can include administration or delivery by any means, systemically, regionally or locally. In particular aspects, a protein or peptide is administered cutaneously, subcutaneously, epicutaneously, intracutaneously, intramuscularly, intravenously, orally, mucosally, by inhalation or nasally. As also set forth herein a protein, peptide, method, use or medicament can include repeatedly contacting a cell with, or administering to a subject, the protein or peptide, multiple times.

Proteins and peptides can be used in diagnostic and detection methods and uses. In one embodiment, detecting an allergic response, or diagnosing an allergy in a subject, a method or use includes contacting a cell from the subject (which may be an ex vivo or in vivo cell) with a protein or peptide as set forth herein; and determining if the protein or peptide modulates an immune response or activity from the contacted cell. If the protein or peptide modulates an immune response or activity from the contacted cell (which may be an ex vivo or in vivo cell) detects an allergic response or indicates that the subject has an allergic response or an allergy. In particular aspects, modulation of immune response or activity is determined by assaying for a hypersensitive reaction or response, such as a cutaneous immunological hypersensitive reaction.

Subjects in accordance with invention include mammals, such as humans. In particular embodiments, a subject has exhibited a symptom of, or suffers from, an allergic reaction, allergic response, allergic disorder or allergic disease. In more particular embodiments, a subject has had an allergic reaction or allergic response to a Timothy Grass allergen or another Grass of the order Poales. In additional particular embodiments, a subject has had an allergic reaction or allergic response to an allergen derived from or produced by Timothy Grass, such as an allergen or an amino acid sequence set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof. In further particular embodiments, a subject has had an allergic reaction or allergic response to an allergen derived from or produced by Timothy Grass selected from Phl p 1, Phl p 5, Phl p6 or a homologous allergen or antigen thereto.

DETAILED DESCRIPTION

Figure 1:
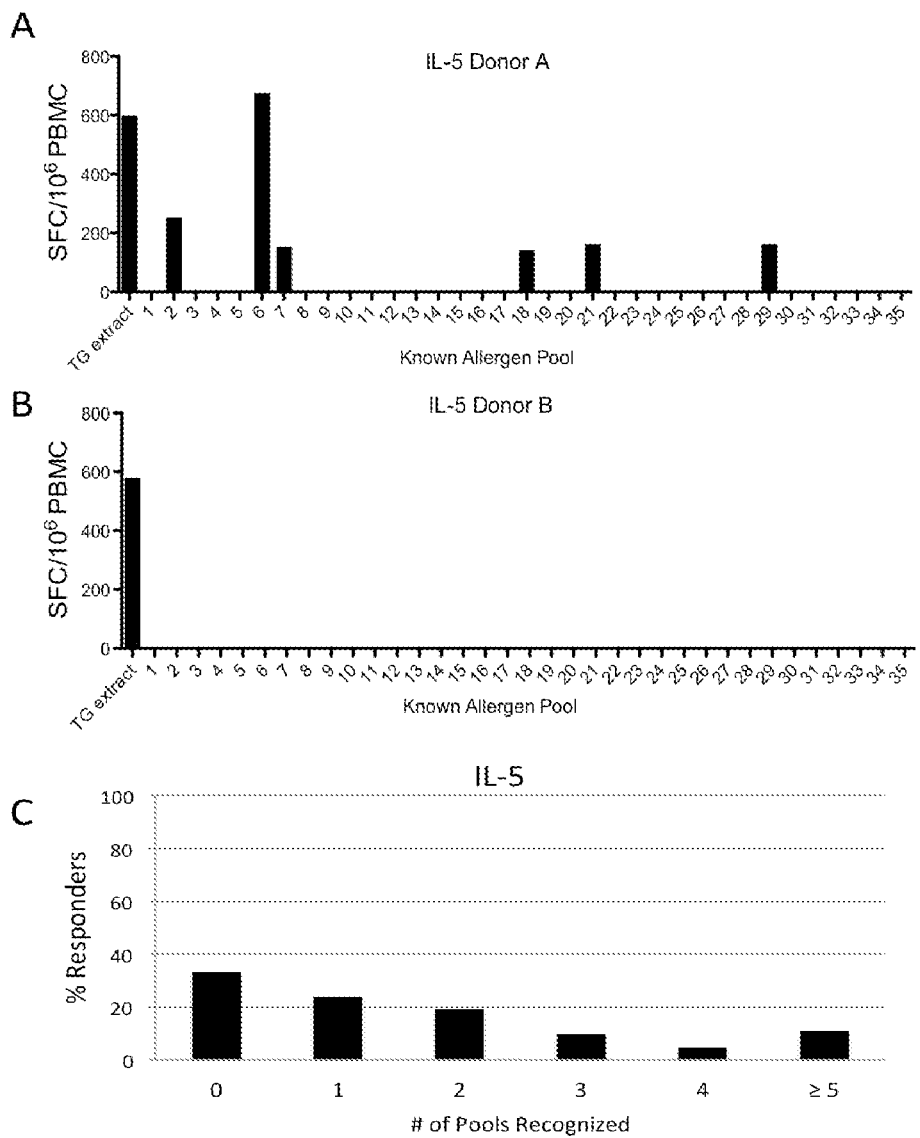
FIG. 1 shows that known allergens do not account for the total T cell response against whole pollen extract. 35 pools (average 20 peptides/pool) of overlapping peptides spanning the ten major TG allergens along with whole TG extract were screened for recognition by PBMCs from allergic donors using IL-5 ELISPOT assays. The majority of donors who had an IL-5 T cell response to TG extract of ≥100 SFC per million input PBMCs showed a response pattern similar to that shown in panel A, with several pools eliciting strong IL-5 responses. However, some donors showed a response pattern as depicted in panel B, where a vigorous response was detected against extract but no response was detected against peptides from known allergens. In total, as shown in panel C, 33% of donors reacted to none of the peptide pools despite strong extract responses (n=21).

As disclosed herein, T cell responses against Timothy Grass (TG) allergen do not correlate with IgE levels and T cell responses in TG pollen allergic individuals. Furthermore, as also disclosed herein a third of the patients studied had no Th2 cell response against any of the known IgE reactive proteins despite having strong responses against whole TG extract. The invention relates to in part to the discovery that TG pollen extract contains novel T cell antigens in addition to the known IgE-inducing allergens.

Thus, in accordance with the invention, there are provided novel Timothy grass proteins and novel Timothy grass peptides, and subsequences, portions, homologues, variants and derivatives thereof. A Timothy grass protein or peptide as described herein may include any Timothy grass protein or peptide, or a subsequence, portion, homologue, variant or derivative thereof. In certain embodiments, a Timothy grass protein or peptide as described herein may include a novel Timothy grass protein or peptide, or a subsequence, portion, homologue, variant or derivative thereof.

In particular embodiments, a Timothy grass protein or peptide described herein includes, consists or consists essentially of a protein or peptide having an open reading frame amino acid sequence set out in Table 1 (SEQ ID NOS:1-620, respectively, in order of appearance), or a subsequence, portion, homologue, variant or derivative thereof (e.g, of all or a part of an amino acid sequence in Table 1 (SEQ ID NOS:1-620, respectively, in order of appearance). In other embodiments, a Timothy grass protein or peptide, includes, consists or consists essentially of an amino acid sequence of a protein or peptide set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof (e.g, of all or a part of an amino acid sequence in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6. In certain embodiments, a Timothy grass protein, peptide, subsequence, portion, homologue, variant or derivative thereof, includes, consists of or consists essentially of an amino acid sequence of a protein or peptide with open reading frame identification M.693, M.692, M.125, M.714, M.721, M.705, M.591, M.418, M.689, M.644, M.414, M.624, M.617, M.704, M.331, M.604, M.291, M.151, M.498, M.561, M.399, M.603, M.226, M.636, M.473, M.437, M.634, M.676, M.422, M.431, M.387, M.722, M.610, M.574, M.531, M.305, M.282, M.271, M.159, M.83, M.348, M.285, M.288, M.287, M.212, M.715, M.725, M.694, M.701, M.595, M.718, M.720, M.723, M.648, M.662, M.576, M.618, M.631, M.682, M.421, M.654, M.393, M.669, M.625, M.655, M.524, M.570, M.341, M.342, M.450, M.343, M.639, M.555, M.546, M.606, M.628, M.248, M.466, M.328, M.695, M.658, M.560, M.548, M.269, M.728, M.653, M.759, M.765, M.747, M.763, M.733, M.651, M.677, M.597, M.547, M.761, M.571, M.562, M.657, M.738, M.734, M.621, M.741, M.177, M.579, M.513, M.446, M.388, M.391, M.593, M.506, M.395, M.381, M.372, M.619, M.656, M.525, M.698, M.699, M.439, M.630, M.708, M.620, M.758, M.764, M.746, M.762, M.716, M.726, MN.66, M.717, M.727, M.719, M.724, M.577, M.8, M.235, M.678, M.675, M.641, M.499, M.583, M.649, M.6, M.29, M.34, M.183, M.101, M.149, M.164, M.129, M.45, M.116, M.165, M.146, M.69, M.123, M.107, M.3, M.113, M.204, M.174, M.178, M.191, M.580, M.587, M.594, M.539, M.569, M.588, M.615, M.578, M.352, M.514, M.419, M.443, M.540, M.640, M.642, M.646, M.627, M.626, M.645, M.652, M.650, M.559, M.622, M.565, M.567, M.581, M.609, M.182, M.134, M.283, M.297, M.367, M.84, M.189, M.586, M.496, M.255, M.471, M.575, M.163, M.314, M.194, M.294, M.472, M.369, M.104, M.206, M.24, M.469, M.420, M.444, M.697, M.687, M.713, M.638, M.673, M.700, M.702, M.707, M.710, M.683, M.670, M.643, M.663, M.664, M.666, M.748, M.731, M.735, M.750, M.752, M.756, M.754, M.608, M.740, M.39, M.303, M.389, M.390, M.284, M.201, M.28, M.364, M.344, M.74, M.180, M.317, M.298, M.192, M.77, M.92, M.144, M.9, M.296, M.187, M.172, M.72, M.38, M.239, M.289, M.240, M.214, M.365, M.614, M.598, M.632, M.633, M.616, M.690, M.607, M.672, M.545, M.671, M.272, M.301, M.202, M.492, M.647, M.457, M.686, M.495, M.486, M.729, M.760, M.668, M.599, M.417, M.635, M.584, M.592, M.709, M.489, M.392, M.347, M.458, M.464, M.415, M.520, M.410, M.467, M.494, M.374, M.118, M.346, M.318, M.519, M.600, M.254, M.438, M.479, M.523, M.380, M.480, M.371, M.482, M.261, M.108, M.260, M.556, M.461, M.400, M.474, M.490, M.491, M.401, M.470, M.409, M.435, M.553, M.537, M.402, M.481, M.483, M.554, M.538, M.234, M.237, M.264, M.563, M.566, M.532, M.557, M.573, M.549, M.550, M.551, M.558, M.463, M.684, M.739, M.637, M.517, M.712, M.732, M.711, M.730, M.736, M.737, M.247, M.13, M.57, M.61, M.47, M.43, M.32, M.518, M.267, M.73, M.270, M.150, M.366, M.679, M.680, M.230, M.530, M.667, M.505, M.488, M.445, M.436, M.508, M.688, M.613, M.487, M.552, M.572, M.336, M.534, M.213, M.384, M.220, M.147, M.127, M.145, M.33, M.110, M.173, M.50, M.249, M.18, M.5, M.25, M.394, M.329, M.330, M.345, M.323, M.316, M.130, M.131, M.203, M.227, M.128, M.70, M.292, M.526, M.585, M.681, M.685, M.596, M.660, M.674, M.703, M.504, M.515, M.521, M.493, M.497, M.509. M.533, M.484, M.302, M.478, M.222, M.691, M.510, M.119, M.535, M.543, M.528, M.529, M.373, M.590, M.361, M.432, M.477, M.408, M.568, M.589, M.462, M.516, M.522, M.412, M.4, M.256, M.56, M.55, M.64, M.22, M.148, M.205, M.332, M.171, ME.3566, ME.4276, ME.4056, ME.3805, ME.3720, ME.3916, ME.3855, ME.1412, ME.4234, ME.4088, ME.4115, ME.4210, ME.3897, ME.4229, ME.4231, ME.4280, ME.4281, ME.1571, ME.4190, ME.4230, ME.3882, MN.82, MN.124, MN.169, MN.185, MN.140, MN.201, MN.193, MN.183, MN.184, MN.173, MN.210, MN.206, MN.136, MN.94, MN.83, MN.14, MN.3, MN.46, MN.17, MN.20, MN.12, MN.35, MN.15, MN.38, MN.74, MN.41, MN.67, MN.27, MN.75, MN.47, MN.33, MN.86, MN.59, MN.8, MN.51, MN.62, MN.56, MN.30, MN.81, MN.91, MN.36, MN.71, MN.80, MN.76, MN.96, MN.106, MN.90, MN.57, MN.25, MN.108, MN.186, MN.58, MN.6, MN.77, MN.107, MN.203, MN.204, MN.211, MN.205, MN.68, MN.98, MN.93, MN.113, MN.123, MN.69, MN.178, MN.182, MN.4, MN.166, MN.167, MN.172, MN.168, MN.105, MN.39, MN.194, MN.195, MN.101, MN.116, MN.181, MN.97, MN.54, MN.156. MN.117, MN.163, MN.175, MN.102, MN.202, MN.157, MN.119, MN.114, MN.92, MN.88, MN.153, MN.95, MN.128, MN.122, MN.118, MN.99, MN.72, MN.214, MN.219, MN.220, MN.199, MN.224, MN.218, MN.215, MN.207, MN.223, MN.221, MN.222, MN.216, MN.162, MN.142, MN.158, MN.141, MN.53, MN.111, MN.112, MN.120, MN.130, MN.132, MN.127, MN.121, MN.139, MN.146, MN.64, MN.87, MN.89, MN.37 or MN.164, or subsequence, portion, homologue, variant or derivative thereof. The foregoing and other TG proteins and peptides set forth herein may be used in the methods and uses, including methods and uses disclosed herein.

In particular embodiments, a protein or peptide includes, consists of or consists essentially of a Timothy Grass amino acid sequence set forth in Table 1 (SEQ ID NOS 1-620), or a subsequence, portion, homologue, variant or derivative thereof. Said homologues may have at least 65%, 70, 75, 80, 85, 90 or 95% homology or identity to the corresponding Timothy Grass amino acid sequence set forth in Table 1 (SEQ ID NOS 1-620), Table 2 (SEQ ID NOS 621-1442), Table 4 (SEQ ID NOS 621-1442) or Table 6. Such subsequences may be 7 to 30 amino acids in length, and optionally further where at least 7 amino acids has at least 75%, or at least 80%, 85%, 90% identity or homology to at least 7 contiguous amino acids of the corresponding Timothy Grass amino acid sequence set forth in Table 1(SEQ ID NOS 1-620), Table 2 (SEQ ID NOS 621-1442), Table 4 (SEQ ID NOS 621-1442) or Table 6. Moreover, a subsequence may be 7 to 25 amino acids in length, such as 7 to 20; 8 to 30; 8 to 25; 8 to 20; 9 to 30; 9 to 25; 9 to 20; 10 to 30; 10 to 25; 10 to 30 amino acids in length and wherein at least 8, such as at least 9, 10, 11, 12, 13, 14 or 15 amino acids of the subsequence has at least 75%, such as at least 80%, 85%, 90% identity or homology to at least 8, such as at least 9, 10, 11, 12, 13, 14 or 15 amino acids, respectively, contiguous amino acids of said corresponding Timothy Grass amino acid sequence set forth in Table 1(SEQ ID NOS 1-620), Table 2 (SEQ ID NOS 621-1442), Table 4 (SEQ ID NOS 621-1442) or Table 6. In various aspects, a protein or peptide does not consist of a sequence set forth in Table 1 as SEQ ID NOs:204, 205, 206, 207, 208, 209, 210, 211, 212, 213, 282, 283, 284, 285, 286, 287, 289, 290, 291, 292, 293, 294, 295, 296, 489, 490 and/or 491.

In additional particular embodiments, a protein or peptide includes, consists of or consists essentially of an amino acid sequence set forth in Table 2 (SEQ ID NOS 621-1442), Table 4 (SEQ ID NOS 621-1442), Table 6 or a variant or derivative thereof. A variant may be a longer peptide, for example, of up to 30 amino acids in length and which includes a corresponding amino acid sequence as set forth in Table 2 (SEQ ID NOS 621-1442), Table 4 (SEQ ID NOS 621-1442) or Table 6. A variant may also include a peptide of 7 to 30 amino acids in length and which includes a subsequence of at least 7 amino acids having at least 75% identity or homology, such as at least 80 or 85% identity or homology, to at least 7 contiguous amino acids of the corresponding amino acid sequence set forth in Table 2 (SEQ ID NOS 621-1442), Table 4 (SEQ ID NOS 621-1442) or Table 6. A longer variant peptide may be up to 25 amino acids in length, such as up to 24, 23, 22, 21, 20, 19 or 19 amino acids in length. The variant may be a peptide of 7 to 25 amino acids in length, such as 7 to 20; 8 to 30; 8 to 25; 8 to 20; 9 to 30; 9 to 25; 9 to 20; 10 to 30; 10 to 25; 10 to 30 amino acids in length and wherein said subsequence is of at least 8, 9 or 10 amino acids having at least 75% (such as at least 80% or 85%) identity or homology to at least 8, 9 or 10 contiguous amino acids, respectively, of said corresponding amino acid sequence set forth in Table 2 (SEQ ID NOS 621-1442), Table 4 (SEQ ID NOS 621-1442) or Table 6. In various aspects, a protein or peptide does not consist of sequences set forth in Table 4 as SEQ ID NOs: 695, 720, 776, 857, 939, 1027, 1028, 1029, 1113, 1218, 1294, 1311, and/or 1312.

As used herein, an "antigen" refers to a substance, including but not limited to a protein or peptide that elicits, induces, stimulates, promotes or enhances an immune response when administered to a subject. An immune response elicited by an antigen may include, but is not limited to, a B cell or a T cell response. An immune response can include a cellular response with a particular pattern of lymphokine/cytokine production (e.g., Th1, Th2), a humoral response (e.g., antibody production), or a combination thereof, to a particular antigen. For example, if a subject previously exposed to an allergen (i.e., is sensitized or is hypersensitive) comes into contact with the allergen again, allergic asthma may develop due to a Th2 response characterized by an increased production of type 2 cytokines (e.g., IL-4, IL-5, IL-9, and/or IL-13) secreted by CD4+ T lymphocytes.

As used herein an "epitope" refers to a region or part of an antigen that elicits an immune response when administered to a subject. In particular embodiments, an epitope may be comprised of a region or part of a Timothy grass protein or peptide (e.g, of all or a part of an amino acid sequence in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6. In more particular embodiments, an epitope may be comprised of a region or part of a TG protein or peptide set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6. In particular aspects, an epitope is a T cell epitope, i.e., an epitope that elicits, stimulates, induces, promotes, increases or enhances a T cell activity, function or response.

An antigen, epitope, allergen, or composition thereof can modulate an undesired or abnormal inflammatory response. An antigen, epitope, allergen, or composition thereof as described herein may alter the Th2 response by, for example, shifting the immune response toward a Th1 phenotype that is less damaging. That is, an altered (or modulated) immune response can decrease, inhibit, suppress, or reduce sensitivity (desensitize) to an antigen, epitope, or allergen, or against inflammatory responses (e.g., allergy, asthma, rash, wheezing, coughing, eye irritation, etc.) caused by an antigen, epitope, or allergen (e.g., a TG protein or peptide set forth in Table 1 (SEQ ID NOS 1-620), Table 2 (SEQ ID NOS 621-1442), Table 4 (SEQ ID NOS 621-1442) or Table 6).

Accordingly, non-limiting examples of antigens, allergens are peptides and proteins having defined amino acid sequences and which comprise T cell epitopes, i.e., elicit, stimulate, induce, promote, increase or enhance a T cell response or activity. Antigens and allergens can be analyzed to determine whether they include at least one T cell epitope using any number of assays (e.g. T cell proliferation assays, lymphokine secretion assays, T cell non-responsiveness studies, etc.).

The term "allergen" refers to an antigen which elicits, induces, stimulates, or enhances an immune response by a cell or the immune system of an exposed animal (e.g., human). An antigen is an allergen when the specific immune response is the development of enhanced sensitivity or a hypersensitivity to the antigen, but the antigen itself is not typically innately harmful. An allergen is therefore a particular type of antigen that can cause development of enhanced or increased sensitivity or hypersensitivity in a subject. For example, an allergen can elicit production of IgE antibodies in predisposed subjects. However, as disclosed herein an allergen need not elicit production of IgE antibodies. Other examples of responses elicited by allergens include T cell responses or activity, such as production of a lymphokine, cytokine, or effector function on other cells. Responses caused by allergens are also described, for example, in Mol. Biol. of Allergy and Immunology, ed. R. Bush, Immunology and Allergy Clinics of North American Series (August 1996). Although the terms "allergen" and "antigen" have a different meaning, reference to "allergen" herein includes reference to "antigen" and reference to "antigen" herein includes reference to "allergen."

Typically, allergens are organic substances, such as proteins, peptides, nucleotides, carbohydrates, lipids, fats, nucleic acid, and combinations or mixtures thereof. Allergen(s) as used herein include, but are not limited to a specific allergen protein, mixture of allergen proteins, an extract of an allergen, chemically or genetically manufactured allergen, or any combination thereof (e.g., a TG protein or peptide set forth in Table 1 (SEQ ID NOS 1-620), Table 2 (SEQ ID NOS 621-1442), Table 4 (SEQ ID NOS 621-1442) or Table 6).

In certain embodiments, proteins, peptides, subsequences, portions, homologues, variants and derivatives thereof, described herein (e.g., a TG protein or peptide set forth in Table 1 (SEQ ID NOS 1-620), Table 2 (SEQ ID NOS 621-1442), Table 4 (SEQ ID NOS 621-1442) or Table 6) stimulate, induce, promote, increase or enhance an immune response. In particular embodiments, a protein or peptide is a T cell antigen, allergen or epitope. In additional particular embodiments, a protein or peptide, a subsequence, portion, homologue, variant or derivative thereof, elicit, stimulate, promote, induce or enhance a T cell response, which may include but is not limited to a Th2 cell response. In further particular embodiments, a TG protein or peptide, a subsequence, portion, homologue, variant or derivative thereof, modulates, inhibits, or reduces T cell response, which may include but is not limited to a Th2 cell response. In certain embodiments, a T cell response is an anti-allergen immune response, including but not limited to an anti-TG immune response.

As used herein, the term "immune response" includes T cell (cellular) mediated and/or B cell (humoral) mediated immune responses, or both cellular and humoral responses. Exemplary immune responses include T cell responses, e.g., lymphokine production, cytokine production and cellular cytotoxicity. T-cell responses include Th1 and/or Th2 responses. In addition, the term immune response includes responses that are indirectly effected by T cell activation, e.g., antibody production (humoral responses) and activation of cytokine responsive cells, e.g., eosinophils, macrophages. Immune cells involved in the immune response include lymphocytes, such as T cells (CD4+, CD8+, Th1 and Th2 cells, memory T cells) and B cells; antigen presenting cells (e.g., professional antigen presenting cells such as dendritic cells, macrophages, B lymphocytes, Langerhans cells, and non-professional antigen presenting cells such as keratinocytes, endothelial cells, astrocytes, fibroblasts, oligodendrocytes); natural killer (NK) cells; myeloid cells, such as macrophages, eosinophils, mast cells, basophils, and granulocytes.

As set forth herein, a particular immunoglobulin (Ig) isotype may be produced in response to an antigen (allergen). For example, an "IgG antigen" refers to an antigen that induces an IgG antibody response. Likewise, an "IgE antigen" refers to an antigen that induces an IgE antibody response; an "IgA antigen" refers to an antigen that induces an IgA antibody response, and so forth. In certain embodiments, such an immunoglobulin (Ig) isotype produced in response to an antigen may also elicit production of other isotypes. For example, an IgG antigen may induce an IgG antibody response in combination with one more of an IgE, IgA, IgM or IgD antibody response. Accordingly, in certain embodiments, an IgG antigen may induce an IgG antibody response without inducing an IgE, IgA, IgM or IgD antibody response.

The invention encompasses methods and uses for reducing, decreasing, preventing the development of sensitization or hypersensitization to an antigen(s) or allergen(s), such as a TG antigen or allergen. Accordingly, in other embodiments, a protein or peptide, subsequence, portion, homologue, variant or derivative thereof (e.g., a TG protein or peptide set forth in Table 1 (SEQ ID NOS 1-620), Table 2 (SEQ ID NOS 621-1442), Table 4 (SEQ ID NOS 621-1442) or Table 6), decreases, inhibits, suppresses or reduces a T cell response, which may include but is not limited to a Th2 cell response. In certain embodiments, the T cell response is an anti-allergen immune response, such as a memory T cell response.

In accordance with another aspect of the invention there are provided a TG protein or peptide, a subsequence, portion, homologue, variant or derivative thereof, wherein the protein or peptide elicits, stimulates, induces, promotes, increases or enhances an anti-allergen immune response. In another aspect, there are provided a TG protein or peptide, subsequence, portion, homologue, variant or derivative thereof, wherein the protein or peptide decreases, reduces, inhibits, suppresses or disrupts an anti-allergen immune response.

As will be understood by a person of skill in the art, a protein or a subsequence, portion, homologue, variant or derivative thereof as described herein (e.g., a TG protein or peptide set forth in Table 1 (SEQ ID NOS 1-620), Table 2 (SEQ ID NOS 621-1442), Table 4 (SEQ ID NOS 621-1442) or Table 6), may elicit, stimulate, induce, promote, increase or enhance certain elements of an anti-allergen immune response while decreasing, reducing, inhibiting, suppressing or reducing other elements of the anti-allergen response, either contemporaneously or sequentially. In one non-limiting example, a protein or a subsequence, portion, homologue, variant or derivative thereof (e.g., a TG protein or peptide set forth in Table 1 (SEQ ID NOS 1-620), Table 2 (SEQ ID NOS 621-1442), Table 4 (SEQ ID NOS 621-1442) or Table 6) may elicit, stimulate, induce, promote, increase or enhance proliferation of regulatory T cells while decreasing, reducing, inhibiting, suppressing or reducing production of proinflammatory lymphokines/cytokines.

An "anti-allergen," "anti-protein," or "anti-peptide immune response" refers to an immune response that is particular or specific for the protein or peptide, e.g., allergen. In such instances, the response is specifically triggered (elicited, stimulated, increased, induced, or promoted) by the protein or peptide, e.g., allergen (e.g., a TG protein or peptide). Although an "anti-allergen" immune response is specifically triggered by a given allergen, the immune response itself can be characterized by general features of immune responses, such as T cell (cellular) and/or B cell (humoral) immune responses, as set forth herein.

As disclosed herein, a TG protein, peptide, subsequence, portion, homologue, variant or derivative thereof, may elicit, stimulate, induce, promote, increase or enhance immunological tolerance to an antigen, including an allergen (e.g., a TG protein or peptide set forth in Table 1 (SEQ ID NOS 1-620), Table 2 (SEQ ID NOS 621-1442), Table 4 (SEQ ID NOS 621-1442) or Table 6). In certain embodiments, a TG protein, peptide, subsequence, portion, homologue, variant or derivative thereof, described herein may elicit, stimulate, induce, promote, increase or enhance immunological tolerance to an allergen. Thus in certain embodiments a protein, peptide, subsequence, portion, homologue, variant or derivative thereof, described herein may be effective in use or treatment (e.g., therapeutic) of an allergic reaction or allergic immune response, including but not limited to an allergic response following a secondary or subsequent exposure of a subject to an antigen or allergen. In particular embodiments, immunological tolerance elicited, stimulated, induced, promoted, increased or enhanced from use or administration of a TG protein, peptide, subsequence, portion, homologue, variant or derivative thereof, may involve modulation of T cell activity, including but not limited to CD4+ T cells, CD8+ T cells, Th1 cells, Th2 cells and regulatory T cells (Tregs), and memory T cells. For example, immunological tolerance elicited, stimulated, induced, promoted, increased or enhanced from use or administration of a TG protein, peptide, subsequence, portion, homologue, variant or derivative thereof (e.g., a TG protein or peptide set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6)-inflammatory lymphokines/cytokines produced by T cells. Thus, in accordance with certain aspects of the invention, there are provided TG proteins, peptides, subsequences, portions, homologues, variants and derivatives thereof, that elicit, stimulate, induce, promote, increase or enhance immunological tolerance to an antigen or allergen (e.g., a TG protein or peptide).

Accordingly, methods and uses of inducing immunological tolerance in a subject to an allergen are provided. In one embodiment, a method or use reduces occurrence, frequency, severity, progression, or duration of physiological conditions, disorders, illnesses, diseases, symptoms or complications caused by or associated an allergic response to the allergen in the subject. Thus, in various embodiments, inducing immunological tolerance can protect a subject against or treat a subject for an allergic response, allergic disorder or allergic disease, or one or more physiological conditions, disorders, illnesses, diseases, symptoms or complications caused by or associated with an allergen.

As disclosed herein, surprisingly TG proteins and antigens that elicit Th2 immune responses are not a priori IgE reactive. Thus, there are provided methods and uses of providing specific immunotherapy to a subject, in which a subject is administered an amount of a protein or peptide that is an IgG, IgA, IgM or IgD antigen. In a particular embodiment, a method or use includes administering to the subject an amount of a protein or peptide that is an IgG antigen.

In certain embodiments of the invention methods and uses, the allergen is a TG protein or peptide. In more particular embodiments, the allergen is an amino acid sequence of a protein or peptide set forth in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6, or a subsequence, portion, homologue, variant or derivative thereof. In other non-limiting embodiments, the allergen includes, consists of or consists essentially of an amino acid sequence set forth in Table 1 (SEQ ID NOS 1-620), Table 2 (SEQ ID NOS 621-1442), Table 4 (SEQ ID NOS 621-1442) or Table 6.

In other embodiments of invention methods and uses, the allergen is not a Timothy grass protein or peptide. Non-limiting examples of such allergens include proteins and peptides from grass, trees, dust mites, insects, pollen, including but not limited to alder, *Alternaria* rot fungus, American cockroach, American house dust mite, Ash, *Aspergillus fumigatus*, Bermuda grass, Birch, Canary grass, Cat, *Cladosporium herbarum*, Common cypress, Cypress, Date palm, Dog, English plantain, European house dust mite, Giant ragweed, Japanese cypress, Kentucky blue grass, *Lolium perenne, Orchard grass, Penicillium chrysogenum*, Prickly juniper, Russian thistle, Rye grass, Sweet vernal grass or White oak.

An allergic reaction refers to a local or general reaction in a subject following contact with a specific antigen (e.g., allergen) to which the subject had been previously exposed and had become sensitized. The immunologic interaction of antigen (e.g., allergen) with sensitized lymphocytes (T cells) and/or antibody can give rise to inflammation and tissue damage. An allergy is an undesirable immune response or reaction that can therefore produce damage to self-tissues and cells, usually through inflammatory reactions.

One non-limiting example of an allergy is asthma. Asthma, which can be extrinsic or allergic asthma (also referred to as reactive airway disease), is an inflammatory disease of the lungs characterized by a generally reversible airway obstruction. Non-limiting features of allergic asthma include elevated concentrations of serum IgE, pulmonary eosinophilia, airway hyper-responsiveness, excessive airway mucus production, and airway remodeling marked by peribronchiolar collagen deposition and increases in airway smooth muscle mass. Other exemplary allergic reactions or inflammatory conditions include allergic alveolitis, allergic bronchopulmonary aspergillosis, allergic dermatitis, eczema, allergic conjunctivitis, allergic coryza, allergic vasculitis, rhinosinusitis, and allergic rhinitis.

Hypersensitivity or hyper-responsiveness used in reference to an immune response means an abnormal response or condition in which an antigen or allergen elicits an exaggerated immune response. For example, allergic asthma can result from repeated exposure to airborne allergens that trigger detrimental immunological responses, such as persistent inflammation in the bronchial wall, which can in turn cause structural and functional changes in the respiratory system. After allergen contact by sensitized subjects (i.e., those subjects that have already been exposed to the allergen), the immune response is dependent on CD4+ T lymphocytes that are skewed to a T helper (Th) 2 phenotype. Th2 cytokines, for example, IL-4, IL-5, IL-9, and IL-13 are produced and are believed to contribute to asthma pathogenesis. For example, IL-4 drives the T helper response in favor of Th2, resulting in enhanced production of IgE; IL-5, which with granulocyte macrophage colony stimulating factor (GM-CSF) and IL-3, is important for the production of eosinophils; and IL-13, which is required for airway hyper-responsiveness and mucous metaplasia, which are downstream pathophysiological features that are closely linked with clinical asthma. All of these cytokines, together with TGF-beta have been implicated in airway remodeling. Increased numbers of airway eosinophils is also associated with disease severity, although the role of eosinophils in the pathology of asthma is not entirely understood, (see, e.g., Lee et al., Science 305:1773 (2004); Humbles et al., Science 305:1776 (2004)). The resulting structural and morphometric changes (remodeling) include subepithelial fibrosis, goblet cell hyperplasia and metaplasia, which result in functional consequences such as loss of distensibility of asthmatic airways, bronchial hyper-reactivity (even in the absence of the allergen), and an accelerated progressive decrease in forced expiratory volume at 1 second time intervals. Th2 cytokines may also prime and activate eosinophils to release proinflammatory agents, lipid mediators, and other cytokines thought to contribute to the observed tissue damage, remodeling, and hyper-responsiveness.

As used herein, the term "tolerance," "anergy," or "antigen (allergen)-specific tolerance" refers to a reduction, loss, inhibition, suppression or decrease, of T cells to T cell receptor-mediated stimulation by an allergen or antigen. The reduction can lead to educed or non-responsiveness (insensitivity) of T cells to an allergen or antigen. Such insensitivity is generally antigen-specific and persists after exposure to the antigenic peptide has ceased. For example, tolerance in T cells is characterized by lack of lymphokine/cytokine production, e.g., IL-2, IFN-γ, or TNF-β. T-cell anergy occurs when T cells are exposed to antigen or allergen and receive a first signal (a T cell receptor or CD-3 mediated signal) in the absence of a second signal (a costimulatory signal). Under these conditions, re-exposure of the cells to the same antigen or allergen (even if re-exposure occurs in the presence of a costimulatory molecule) results in failure to produce cytokines and subsequently failure of T cells to proliferate. Thus, a failure to produce lymphokines/cytokines prevents proliferation. Tolerized T cells can, however, proliferate if cultured with cytokines (e.g., IL-2). For example, T cell anergy can also be observed by the lack of IL-2 production by T lymphocytes as measured by ELISA or by a proliferation assay using an indicator cell line.

As used herein, the term "immunological tolerance" refers to a) a decreased or reduced level of a specific immunological response (thought to be mediated at least in part by antigen-specific effector T lymphocytes, B lymphocytes, antibody, a combination); b) a delay in the onset or progression of a specific immunological response; or c) a reduced risk of the onset or progression of a specific immunological response to an antigen or allergen. "Specific" immunological tolerance occurs when tolerance is preferentially invoked against certain antigens (allergens) in comparison with other antigens (allergens). Tolerance is an active antigen dependent process and differs from non-specific immunosuppression and immunodeficiency.

An increase, improvement, enhancement or induction of "tolerance" refers to a decrease, reduction, inhibition, suppression, or limiting or controlling or clearing of specific immunological reactivity to an antigen as compared to reactivity to the antigen in a previous exposure to the same antigen. Thus, in certain embodiments, a method or use of inducing immunological tolerance in a subject to an allergen includes elimination of an allergic response of the subject to the allergen. Immunological tolerance in a subject to an allergen can also be reflected by reducing the occurrence, frequency, severity, progression, or duration of an allergic response of the subject to the antigen or allergen.

While desirably tolerance can refer to non-reactivity to an antigen or allergen, tolerance need not be complete non-reactivity and can only be partial, and in any event is reflected by a decrease, inhibition, suppression or reduction in specific immunological reactivity to an antigen or allergen as compared to reactivity to the antigen or allergen in a previous exposure to the same antigen or allergen (or epitope thereof). Thus, in another embodiment, a method or use of inducing immunological tolerance in a subject to an allergen includes stabilizing or maintaining the level of an allergic response in the subject to the allergen.

Induction of immune tolerance (also referred to as desensitization), and the relative amount of immune tolerance, can be measured by methods disclosed herein or known to the skilled artisan. For example, induction of immune tolerance can be measured by modulation of lymphokine and/or cytokine level in said animal. As such, modulation can be an increase of a cytokine level, for instance an increase of a cytokine level at least 1.5, 2, 3 times or more relative to before said induction. Alternatively, modulation can be a decrease of the level of a particular cytokine level, for instance a decrease of the cytokine level is at least 1.5, 2, 3 times or more relative to before said induction. The lymphokines/cytokines chosen to measure can be from any relevant lymphokines/cytokines, such as IL-2, IL-5, IL-4, IL-6, IL-10, IL-12, IL-13, TNF-α, IFN-γ, IFN-α, TGF-β, MCP-1, RANK-L and Flt3L.

As disclosed herein, peptides and proteins of the invention are useful in methods and uses, for example, of "specific" immunotherapy. The term "specific" immunotherapy refers to a therapy particular or specific for the protein or peptide, e.g., allergen. To achieve "specific immunotherapy" an antigen is administered to a subject in order to achieve immunological tolerance of the subject to an antigen, including for example, an allergen.

More particularly, specific immunotherapy may be conducted by administering an antigen derived from the antigen (e.g. allergen) against which immunological tolerance is sought. Alternatively, immunotherapy can be conducted by "non-specific" immunotherapy using a different antigen or protein than the antigen against which immunological tolerance is sought. For example as described in US patent application publication US2012/0100164A1, which relates to the treatment of a hypersensitivity immune response, such as allergic rhinitis or asthma, via bystander suppression by use of an antigen unrelated to the allergen triggering the hypersensitivity immune response in an individual to be treated provided that the antigen is obtainable from the source material, e.g. Grass pollen, comprising the "triggering" allergen (e.g. Phl p 1, 5 or 6).

Thus, in different embodiments, the TG antigen administered and antigen (e.g. allergen) against which immunological tolerance is sought may be the same or a different TG protein. In one embodiment, a method or use includes administering to a subject an amount of a TG protein or peptide, or subsequence, portion, homologue, variant or derivative thereof sufficient to elicit, stimulate, induce, promote, increase, enhance or augment immunological tolerance to an allergen in the subject. In one aspect, a TG antigen is administered to a subject during specific immunotherapy to treat the subject for an allergic reaction to the same TG antigen. In a different aspect, a TG antigen is administered to a subject during specific immunotherapy to treat the subject for an allergic reaction to a different TG antigen. In another embodiment, a method includes administering to a subject an amount of a nucleic acid encoding all or a portion (e.g., a T cell epitope) of a Timothy grass protein or peptide, or subsequence, portion, homologue, variant or derivative thereof sufficient to elicit, stimulate, induce, promote, increase, enhance or augment immunological tolerance to an allergen in the subject. In various embodiments, a method or use of specific immunotherapy reduces, inhibits, suppresses or decreases sensitivity or (hyper)sensitivity to the protein or peptide, e.g., allergen, or elicits, stimulates, increases, induces, promotes or improves tolerance of the protein or peptide, e.g., allergen. Typically a subject is administered a protein or peptide, e.g., allergen, for example, via a subcutaneous injection.

Methods and uses include multi-dose regimens. For example, a method or use can begin with small doses of allergen, and the doses are increased for repeated contact or administration.

A variant or derivative of an antigen (e.g., a TG protein or peptide set forth in Table 1 (SEQ ID NOS 1-620), Table 2 (SEQ ID NOS 621-1442), Table 4 (SEQ ID NOS 621-1442) or Table 6), including an allergen as described herein, or a subsequence or portion of an antigen or allergen, include molecules that are structurally similar and functionally similar (e.g, of all or a part of an amino acid sequence in Table 1 (SEQ ID NOS 1-620, respectively, in order of appearance), Table 2 (SEQ ID NOS 621-1442, respectively, in order of appearance), Table 4 (SEQ ID NOS 621-1442, respectively, in order of appearance) or Table 6). A variant, derivative or subsequence of antigen or allergen is functionally similar to the antigen or allergen sequence if the variant, derivative or subsequence is capable of eliciting a detectable or measurable immune response, even if it is a reduced immune response compared to the nonvariant/non-derived or native sequence, which may be determined using methods, including animal models and in vitro assays, described herein and know to one of skill in the art. For example, an immune response may be determined by quantitative and/or qualitative determination of lymphokine/cytokine production (e.g., by T cells), antibody production (including class and/or isotype), cellular mobilization, migration or motility, and optionally in vivo, such as an animal model of antigen/allergen immune responsiveness. An immune response of variant, derivative or subsequence of antigen or allergen compared to the non-variant/non-derivatized/native full length antigen or allergen may be ascertained by analysis of a particular measure (such as lymphokine/cytokine production, immunoglobulin production, cell mobilization, migration, motility, etc.) and may be greater, less than or comparable, e.g., within 5%, 10%, 15%, or 20% or 25% of the immune response of non-variant/non-derivatized/native full length antigen or allergen. For example, levels of Th1 lymphokines/cytokines, such as IFN-γ IL-2, and TNF-β and Th2 cytokines, such as IL-4, IL-5, IL-9, IL-10, and IL-13, may be determined according to methods described herein or known to one of skill in the art.

As disclosed herein, proteins and peptides, or a subsequence, portion, homologue, variant or derivative thereof include those having all or at least partial sequence identity to one or more exemplary proteins and peptides, or a subsequence, portion, homologue, variant or derivative thereof (e.g., TG sequences set forth in Table 1 (SEQ ID NOS 1-620), Table 2 (SEQ ID NOS 621-1442), Table 4 (SEQ ID NOS 621-1442) or Table 6). The term "identity" and "identical" and grammatical variations thereof, mean that two or more referenced entities are the same (e.g., peptides or polynucleotide molecules). Thus, where two proteins, peptides, subsequences, portions, homologues, variants or derivatives thereof are identical, they have the same amino acid sequence. The identity can be over a defined area (region or domain) of the sequence. "Areas, regions or domains" of homology or identity mean that a portion of two or more referenced entities share homology or are the same.

Identity can be determined by comparing each position in aligned sequences. A degree of identity between amino acid sequences is a function of the number of identical or matching amino acids at positions shared by the sequences, i.e. over a specified region. Optimal alignment of sequences for comparisons of identity may be conducted using a variety of algorithms, as are known in the art, including the ClustalW program, available at http://clustalw.genome.ad.jp, the local homology algorithm of Smith and Waterman, 1981, *Adv. Appl. Math* 2: 482, the homology alignment algorithm of Needleman and Wunsch, 1970, *J. Mol. Biol.*

48:443, the search for similarity method of Pearson and Lipman, 1988, *Proc. Natl. Acad. Sci. USA* 85: 2444, and the computerized implementations of these algorithms (such as GAP, BESTFIT, FASTA and TFASTA in the Wisconsin Genetics Software Package, Genetics Computer Group, Madison, Wis., U.S.A.). Sequence identity may also be determined using the BLAST algorithm, described in Altschul et al., 1990, *J. Mol. Biol.* 215:403-10 (using the published default settings). Software for performing BLAST analysis may be available through the National Center for Biotechnology Information (through the internet at http://www.ncbi.nlm.nih.gov/). Such algorithms that calculate percent sequence identity (homology) generally account for sequence gaps and mismatches over the comparison region or area. For example, a BLAST (e.g., BLAST 2.0) search algorithm (see, e.g., Altschul et al., *J. Mol. Biol.* 215:403 (1990), publicly available through NCBI) has exemplary search parameters as follows: Mismatch −2; gap open 5; gap extension 2. For polypeptide sequence comparisons, a BLASTP algorithm is typically used in combination with a scoring matrix, such as PAM100, PAM 250, BLOSUM 62 or BLOSUM 50. FASTA (e.g., FASTA2 and FASTA3) and SSEARCH sequence comparison programs are also used to quantitate the extent of identity (Pearson et al., *Proc. Natl. Acad. Sci.* USA 85:2444 (1988); Pearson, *Methods Mol Biol.* 132:185 (2000); and Smith et al., *J. Mol. Biol.* 147:195 (1981)). Programs for quantitating protein structural similarity using Delaunay-based topological mapping have also been developed (Bostick et al., *Biochem Biophys Res Commun.* 304:320 (2003)).

As described herein, TG proteins and peptides include homologues of TG proteins and peptides (e.g., of allor a part of any amino acid sequence in any of Table 1 (SEQ ID NOS 1-620), Table 2 (SEQ ID NOS 621-1442), Table 4 (SEQ ID NOS 621-1442) or Table 6. A polypeptide sequence or polynucleotide sequence is a "homologue" of, or is "homologous" to, another sequence if the two sequences have substantial identity over a specified region and a functional activity of the sequences is preserved or conserved, at least in part (as used herein, the term 'homologous' does not infer nor exclude evolutionary relatedness).

Examples of "homologues" of invention peptides and proteins include proteins or peptides of non-Timothy grass allergens, including for example other grass allergens such as grasses of the order Poales, that are homologous to a Timothy grass peptide or protein described herein. For example, in particular embodiments, proteins or peptides of the present invention may be proteins or peptides of grasses of the order of Poales, *Panicum virgatum, Zea mays, Oryza sativa, Ricinus communis, Alnus glutinosa, Spinacia oleracea, Sorghum bicolor, Arabidopsis thaliana, Triticum aestivum, Capsella bursa-pastoris, Brassica napus, Mesembryanthemum crystallinum, Gossypium hirsutum, Brassica rapa* subsp. *chinensis, Solanum lycopersicum, Solanum tuberosum, Populus trichocarpa* or *Chara coralline*.

Accordingly, in particular embodiments, methods and uses of the invention include homologues of peptides and proteins from non-Timothy grass allergens, including for example other grass antigens and allergens, such non-TG proteins and peptides considered to be homogoues as set forth herein. Thus, as a non-limiting example, peptide and protein homologues from non-Timothy grass antigens or allergens may be administered to modulate immune activity or immune response against a Timothy grass allergen or antigen or to treat an allergic reaction, allergic response, allergic disorder or allergic disease associated with a Timothy grass allergen or antigen. As another non-limiting example, peptide and protein homologues from non-Timothy grass antigens or allergens may be administered to modulate immune activity or immune response against a non-Timothy grass allergen or antigen or to treat an allergic reaction, allergic response, allergic disorder or allergic disease associated with a non-Timothy grass allergen or antigen.

Two polypeptide sequences or polynucleotide sequences are considered to be substantially identity if, when optimally aligned (with gaps permitted), they share at least about 40% sequence identity or greater (e.g. 45%, 50%, 55%, 60%, 65%, 70%, 75%, 80%, 85%, 90%, 95%, 96%, 97%, 98%, 99%, etc. identify over a specific region), for example, over all or a part of any amino acid sequence in Table 1 (SEQ ID NOS 1-620), Table 2 (SEQ ID NOS 621-1442), Table 4 (SEQ ID NOS 621-1442) or Table 6, or if the sequences share defined functional motifs (e.g., epitopes). The percent identity can extend over the entire sequence length or a portion of the sequence (e.g., over all or a part of any amino acid sequence in any of Table 1 (SEQ ID NOS 1-620), Table 2 (SEQ ID NOS 621-1442), Table 4 (SEQ ID NOS 621-1442) or Table 6. In particular aspects, the length of the sequence sharing the percent identity is 2, 3, 4, 5 or more contiguous amino acids, e.g., 6, 7, 8, 9, 10, 11, 12, 13, 14, 15, 16, 17, 18, 19, 20, etc. contiguous amino acids (e.g., over all or a part of any amino acid sequence in any of Table 1 (SEQ ID NOS 1-620), Table 2 (SEQ ID NOS 621-1442), Table 4 (SEQ ID NOS 621-1442) or Table 6. In additional particular aspects, the length of the sequence sharing the percent identity is 20 or more contiguous amino acids, e.g., 20, 21, 22, 23, 24, 25, 26, 27, 28, 29, 30, 31, 32, 33, 34, 35, etc. contiguous amino acids (e.g., over all or a part of any amino acid sequence in any of Table 1 (SEQ ID NOS 1-620), Table 2 (SEQ ID NOS 621-1442), Table 4 (SEQ ID NOS 621-1442) or Table 6. In further particular aspects, the length of the sequence sharing the percent identity is 35 or more contiguous amino acids, e.g., 35, 36, 37, 38, 39, 40, 41, 42, 43, 44, 45, 45, 47, 48, 49, 50, etc., contiguous amino acids (e.g., over all or a part of any amino acid sequence in any of Table 1 (SEQ ID NOS 1-620), Table 2 (SEQ ID NOS 621-1442), Table 4 (SEQ ID NOS 621-1442) or Table 6. In yet further particular aspects, the length of the sequence sharing the percent identity is 50 or more contiguous amino acids, e.g., 50-55, 55-60, 60-65, 65-70, 70-75, 75-80, 80-85, 85-90, 90-95, 95-100, etc. contiguous amino acids (e.g., over all or a part of any amino acid sequence in any of Table 1 (SEQ ID NOS 1-620), Table 2 (SEQ ID NOS 621-1442), Table 4 (SEQ ID NOS 621-1442) or Table 6.

An "unrelated" or "non-homologous" sequence shares less than 30% identity. More particularly, shares less than about 25% identity, with a protein, peptide or polynucleotide of the invention over a specified region of homology.

A variant or derivative of a protein or peptide refers to a modified or variant form of the protein or peptide, or subsequence, portion or homologue thereof (e.g., over all or a part of any amino acid sequence in any of Table 1 (SEQ ID NOS 1-620), Table 2 (SEQ ID NOS 621-1442), Table 4 (SEQ ID NOS 621-1442) or Table 6). Such modified forms, such as amino acid deletions, additions and substitutions, of the proteins and peptides can also be used in the invention uses, methods and compositions, including methods for modulating an immune response, eliciting, stimulating, inducing, promoting, increasing, or enhancing immunological tolerance and protecting and treating subjects against an allergic reaction or response, as set forth herein.

Thus, in accordance with the invention, modified, variant and derivative forms of proteins and peptides, subsequences, portions, and homologues thereof (e.g., of a TG protein or peptide set forth in Table 1 (SEQ ID NOS 1-620), Table 2 (SEQ ID NOS 621-1442), Table 4 (SEQ ID NOS 621-1442) or Table 6) are provided that have one or more functions or activities of unmodified, non-variant and non-derivatized forms of proteins and peptides. Such forms, referred to as "modifications", "variants" or "derivatives" and grammatical variations thereof deviate from a reference sequence. For example, as described herein, a protein, peptide, subsequence, portion, or homologue thereof may comprise, consist or consist essentially of an amino acid sequence that is a modification, variant, or derivative of a TG protein or an amino acid sequence set forth in Table 1 (SEQ ID NOS 1-620), Table 2 (SEQ ID NOS 621-1442), Table 4 (SEQ ID NOS 621-1442) or Table 6. Such modifications, variants, or derivatives may have greater or less activity or function than a reference protein or peptide, such as ability to elicit, stimulate, induce, promote, increase, enhance, activate, modulate, inhibit, decreases, suppress, or reduce an immune response (e.g. a T cell response) or elicit, stimulate, induce, promote, increase or enhance immunological tolerance (desensitize) to an antigen or allergen. Thus, proteins, peptides, or subsequences, portions or homologues thereof include sequences having substantially the same, greater or less relative activity or function as a reference antigen or allergen (e.g., any of the TG proteins or peptides set forth in any of Table 1 (SEQ ID NOS 1-620), Table 2 (SEQ ID NOS 621-1442), Table 4 (SEQ ID NOS 621-1442) or Table 6) for example, an ability to elicit, stimulate, induce, promote, increase, enhance, activate, modulate, inhibit, suppress, decrease or reduce an immune response (e.g. a T cell response) or elicit, stimulate, induce, promote, increase or enhance immunological tolerance to an antigen or allergen in vitro or in vivo.

A variant or derivative therefore includes deletions, including truncations and fragments; insertions and additions, including tagged polypeptides and fusion proteins; substitutions, for example conservative substitutions, site-directed mutants and allelic variants; and modifications, including peptoids having one or more non-amino acyl groups (q.v., sugar, lipid, etc.) covalently linked to the peptide and post-translational modifications.

Non-limiting examples of modifications include one or more amino acid substitutions (e.g., 1, 2, 3, 4, 5, 6, 7, 8, 9, 10, 11, 12, 13, 14, 15, 16, 17, 18, 19, 20, 20-25, 25-30, 30-50, 50-100, or more residues), additions and insertions (e.g., 1, 2, 3, 4, 5, 6, 7, 8, 9, 10, 11, 12, 13, 14, 15, 16, 17, 18, 19, 20, 20-25, 25-30, 30-50, 50-100, or more residues) and deletions (e.g., 1, 2, 3, 4, 5, 6, 7, 8, 9, 10, 11, 12, 13, 14, 15, 16, 17, 18, 19, 20, 20-25, 25-30, 30-50, 50-100) of a reference protein, peptide, or subsequence or portion thereof (e.g., over all or a part of any amino acid sequence in any of Table 1 (SEQ ID NOS 1-620), Table 2 (SEQ ID NOS 621-1442), Table 4 (SEQ ID NOS 621-1442) or Table 6). In particular embodiments, a modified or variant sequence retains at least part of a function or an activity of unmodified sequence, and can have less than, comparable, or greater, but at least a part of, a function or activity of a reference sequence, for example, the ability elicit, stimulate, induce, promote, increase, enhance, activate, modulate, inhibit, suppress, decrease, or reduce an immune response (e.g. a T cell response) or elicit, stimulate, induce, promote, increase or enhance immunological tolerance to an allergen. Such immune responses include, for example, among others, induced, increased, enhanced, stimulated, activated, modulated, inhibited, suppressed, decreased or reduced expression, production or activity of a cytokine (e.g., IL-5), an antibody (e.g. increase production of IgG antibodies, decrease production of IgE) or an immune cell (e.g. CD4+ T cell, CD8+ T cell, Th1 cell, Th2 cell or regulatory T cell).

Variants and derivatives of proteins and peptides include naturally-occurring polymorphisms or allelic variants, strain variants, as well as synthetic proteins and peptides that contain a limited number of conservative amino acid substitutions of the amino acid sequence. A variety of criteria can be used to indicate whether amino acids at a particular position in a protein or peptide are similar. In making such changes, substitutions of like amino acid residues can be made on the basis of relative similarity of side-chain substituents, for example, their size, charge, hydrophobicity, hydrophilicity, and the like, and such substitutions may be assayed for their effect on the function of the peptide by routine testing.

Specific non-limiting examples of substitutions include conservative and non-conservative amino acid substitutions. A "conservative substitution" is the replacement of one amino acid by a biologically, chemically or structurally similar residue. Biologically similar means that the substitution does not destroy a biological activity. Structurally similar means that the amino acids have side chains with similar length, such as alanine, glycine and serine, or a similar size. Chemical similarity means that the residues have the same charge, or are both hydrophilic or hydrophobic. For example, a conservative amino acid substitution is one in which an amino acid residue is replaced with an amino acid residue having a similar side chain, which include amino acids with basic side chains (e.g., lysine, arginine, histidine); acidic side chains (e.g., aspartic acid, glutamic acid); uncharged polar side chains (e.g., glycine, asparagine, glutamine, serine, threonine, tyrosine, cysteine, histidine); nonpolar side chains (e.g., alanine, valine, leucine, isoleucine, proline, phenylalanine, methionine, tryptophan); beta-branched side chains (e.g., threonine, valine, isoleucine), and aromatic side chains (e.g., tyrosine, phenylalanine, tryptophan). Particular examples include the substitution of one hydrophobic residue, such as isoleucine, valine, leucine or methionine for another, or the substitution of one polar residue for another, such as the substitution of arginine for lysine, glutamic for aspartic acids, or glutamine for asparagine, serine for threonine, and the like. Proline, which is considered more difficult to classify, shares properties with amino acids that have aliphatic side chains (e.g., Leu, Val, Ile, and Ala). In certain circumstances, substitution of glutamine for glutamic acid or asparagine for aspartic acid may be considered a similar substitution in that glutamine and asparagine are amide derivatives of glutamic acid and aspartic acid, respectively. Conservative changes can also include the substitution of a chemically derivatized moiety for a non-derivatized residue, for example, by reaction of a functional side group of an amino acid. Variants and derivatives of proteins and peptides include forms having a limited number of one or more substituted residues.

An addition can be a covalent or non-covalent attachment of any type of molecule. Specific examples of additions include glycosylation, acetylation, phosphorylation, amidation, formylation, ubiquitination, and derivatization by protecting/blocking groups and any of numerous chemical modifications. Additional specific non-limiting examples of an addition are one or more additional amino acid residues. Accordingly, proteins, peptides, subsequences, portions, homologues, variants or derivatives thereof, can be a part of or contained within a larger molecule, such as another protein or peptide sequence, such as a fusion or chimera with a different (distinct) sequence.

In particular embodiments, an addition is a fusion (chimeric) sequence, an amino acid sequence having one or more molecules not normally present in a reference native (wild type) sequence covalently attached to the sequence. The term "chimeric" and grammatical variations thereof, when used in reference to a sequence, means that the sequence contains one or more portions that are derived from, obtained or isolated from, or based upon other physical or chemical entities. For example, a chimera of two or more different proteins may have one part a protein, peptide, subsequence, portion, homologue or variant thereof, and a second part of the chimera may be from a different sequence, or unrelated protein sequence.

Another particular example of a sequence having an amino acid addition is one in which a second heterologous sequence, i.e., heterologous functional domain is attached (covalent or non-covalent binding) that confers a distinct or complementary function. Heterologous functional domains are not restricted to amino acid residues. Thus, a heterologous functional domain can consist of any of a variety of different types of small or large functional moieties. Such moieties include nucleic acid, peptide, carbohydrate, lipid or small organic compounds, such as a drug (e.g., an antiviral), a metal (gold, silver), and radioisotope. For example, a tag such as T7 or polyhistidine can be attached in order to facilitate purification or detection of a protein, peptide, etc. Accordingly, there are provided proteins, peptides, subsequences, portions and homologues thereof (e.g., a TG protein or peptide set forth in Table 1, Table 2, Table 4 or Table 6), and a heterologous domain, wherein the heterologous functional domain confers a distinct function on the protein, peptide, subsequence, portion or homologue thereof.

Linkers, such as amino acid or peptidomimetic sequences may be inserted between the sequence and the addition (e.g., heterologous functional domain) so that the two entities maintain, at least in part, a distinct function or activity. Linkers may have one or more properties that include a flexible conformation, an inability to form an ordered secondary structure or a hydrophobic or charged character, which could promote or interact with either domain. Amino acids typically found in flexible protein regions include Gly, Asn and Ser. Other near neutral amino acids, such as Thr and Ala, may also be used in the linker sequence. The length of the linker sequence may vary without significantly affecting a function or activity of the fusion protein (see, e.g., U.S. Pat. No. 6,087,329). Linkers further include chemical moieties and conjugating agents, such as sulfo-succinimidyl derivatives (sulfo-SMCC, sulfo-SMPB), disuccinimidyl suberate (DSS), disuccinimidyl glutarate (DSG) and disuccinimidyl tartrate (DST).

Further non-limiting examples of additions are detectable labels. Thus, in another embodiment, the invention provides proteins, peptides, subsequences, portions and homologues thereof, that are detectably labeled. Specific examples of detectable labels include fluorophores, chromophores, radioactive isotopes (e.g., $S^{35}$, $P^{32}$, $I^{125}$), electron-dense reagents, enzymes, ligands and receptors. Enzymes are typically detected by their activity. For example, horseradish peroxidase is usually detected by its ability to convert a substrate such as 3,3-',5,5-'-tetramethylbenzidine (TMB) to a blue pigment, which can be quantified.

Another non-limiting example of an addition is an insertion of an amino acid within any protein, peptide, subsequence, portion or homologue thereof (e.g., any protein or sequence set forth herein, such as in any amino acid sequence of Table 1 (SEQ ID NOS 1-620), Table 2 (SEQ ID NOS 621-1442), Table 4 (SEQ ID NOS 621-1442) or Table 6). In particular embodiments, an insertion is of one or more amino acid residues inserted into the amino acid sequence of a protein or peptide, or subsequence, portion or homologue thereof, such as any TG protein or sequence set forth herein, such as in as in Table 1 (SEQ ID NOS 1-620), Table 2 (SEQ ID NOS 621-1442), Table 4 (SEQ ID NOS 621-1442) or Table 6.

Modified and variant proteins, peptides, subsequences, portions or homologues thereof also include one or more D-amino acids substituted for L-amino acids (and mixtures thereof), structural and functional analogues, for example, peptidomimetics having synthetic or non-natural amino acids or amino acid analogues and derivatized forms. Modifications include cyclic structures such as an end-to-end amide bond between the amino and carboxy-terminus of the molecule or intra- or inter-molecular disulfide bond. Proteins, peptides, subsequences, portions and homologues thereof may be modified in vitro or in vivo, e.g., post-translationally modified to include, for example, sugar residues, phosphate groups, ubiquitin, fatty acids, lipids, etc.

Specific non-limiting examples of modified and variant proteins, peptides, subsequences, portions and homologues thereof include proteins or peptides comprising, consisting or consisting essentially of an amino acid sequence comprising at least one amino acid deletion from a full length TG protein or amino acid sequence set forth in any of Table 1 (SEQ ID NOS 1-620), Table 2 (SEQ ID NOS 621-1442), Table 4 (SEQ ID NOS 621-1442) or Table 6. In particular embodiments, a protein, peptide, or subsequence, portion or homologue thereof is from about 2 to up to one amino acid less than the full length protein sequence. In additional particular embodiments, a protein subsequence or portion is from about 2 to 5, 5 to 10, 10 to 15, 15 to 20, 20 to 25, 25 to 50, 50 to 100 amino acids in length, provided that said subsequence or portion is at least one amino acid less in length than the full-length protein sequence.

The term "subsequence" or "portion" means a fragment or part of the full length molecule. A subsequence or portion therefore consists of one or more amino acids less than the full length protein or peptide. A subsequence or portion can have one or more amino acids less than the full length protein or peptide internally or terminal amino acid deletions from either amino or carboxy-termini. Subsequences and portions can vary in size. For example, a subsequence or portion of a protein or peptide can be as small as an epitope capable of binding an antibody (i.e., about five amino acids) up to a polypeptide that is one amino acid less than the entire length of a reference protein or peptide.

As used herein, subsequences and portions may also include or consist of one or more amino acid additions or deletions, wherein the subsequence or portion does not comprise the full length native/wild type protein or peptide sequence. Accordingly, total subsequence or portion lengths can be greater than the length of the full length native/wild type protein or peptide, for example, where a protein or peptide subsequence is fused or forms a chimera with another polypeptide.

The invention provides isolated and/or purified proteins, peptides, subsequences, portions, homologues, variants or derivatives thereof. In particular embodiments, isolated and/or purified proteins, peptides, subsequences, portions, homologues, variants or derivatives thereof, comprise, consist of or consist essentially of an amino acid sequence of a TG protein or peptide set forth in any of Table 1 (SEQ ID NOS 1-620), Table 2 (SEQ ID NOS 621-1442), Table 4 (SEQ ID NOS 621-1442) or Table 6. In particular embodiments, the isolated and/or purified proteins, peptides, subsequences, portions, homologues, variants or derivatives thereof include a T cell epitope (e.g., Th2 cell epitope).

The term "isolated," when used as a modifier of a composition, means that the compositions are made by the hand of man or are separated, completely or at least in part, from their naturally occurring in vivo environment. Generally, isolated compositions are substantially free of one or more materials with which they normally associate with in nature, for example, one or more protein, nucleic acid, lipid, carbohydrate, cell membrane. The term "isolated" does not exclude alternative physical forms of the composition, such as fusions/chimeras, multimers/oligomers, modifications (e.g., phosphorylation, glycosylation, lipidation) or derivatized forms, or forms expressed in host cells produced by the hand of man.

An "isolated" composition (e.g., proteins, peptides, subsequences, portions, homologues, variants or derivatives thereof, for example, of any TG protein or sequence set forth herein, such as in any of Table 1 (SEQ ID NOS 1-620), Table 2 (SEQ ID NOS 621-1442), Table 4 (SEQ ID NOS 621-1442) or Table 6) can also be "substantially pure" or "purified" when free of most or all of the materials with which it typically associates with in nature. Thus, an isolated protein, peptide, subsequence, portion, homologue, variant or derivative thereof, that also is substantially pure or purified does not include polypeptides or polynucleotides present among millions of other sequences, such as peptides of an peptide library or nucleic acids in a genomic or cDNA library, for example.

A "substantially pure" or "purified" composition can be combined with one or more other molecules. Thus, "substantially pure" or "purified" does not exclude combinations of compositions, such as combinations of proteins, peptides, subsequences, portions, homologues, variants or derivatives thereof (e.g., multiple proteins, peptides, subsequences, etc.), and other antigens, agents, drugs or therapies.

Proteins and peptide (e.g., antigens and allergens) can be prepared recombinantly, chemically synthesized, isolated from a biological material or source, and optionally modified, or any combination thereof. A biological material or source would include an organism that produced or possessed any proteins or peptide (e.g., antigen or allergen) set forth herein (e.g., as listed in any of Table 1 (SEQ ID NOS 1-620), Table 2 (SEQ ID NOS 621-1442), Table 3, Table 4 (SEQ ID NOS 621-1442) or Table 6). A biological material or source may further refer to a preparation in which the morphological integrity or physical state has been altered, modified or disrupted, for example, by dissection, dissociation, solubilization, fractionation, homogenization, biochemical or chemical extraction, pulverization, lyophilization, sonication or any other means of manipulating or processing a biological source or material. Subsequences, variants, homologues and derivatives can be prepared, for example, by substituting, deleting or adding one or more amino acid residues in the amino acid sequence of a protein, peptide, subsequence, portion or homologue thereof, and screening for biological activity, for example eliciting an immune response. A skilled person will understand how to make such derivatives or variants, using standard molecular biology techniques and methods, described for example in Sambrook et al. (2001) Molecular Cloning: a Laboratory Manual, 3$^{rd}$ ed., Cold Spring Harbour Laboratory Press).

The invention also provides protein or peptide (e.g., proteins, peptides, subsequences, portions, homologues, variants or derivatives thereof, for example, of any TG protein or sequence set forth herein, such as in as in Table 1 (SEQ ID NOS 1-620), Table 2 (SEQ ID NOS 621-1442), Table 4 (SEQ ID NOS 621-1442) or Table 6, immobilized on or attached to a substrate. The protein or peptide (e.g., proteins, peptides, subsequences, portions, homologues, variants or derivatives thereof, for example, of any TG protein or sequence set forth herein, such as in as in Table 1 (SEQ ID NOS 1-620), Table 2 (SEQ ID NOS 621-1442), Table 4 (SEQ ID NOS 621-1442) or Table 6 can optionally have a unique or distinct position or address on the substrate.

Substrates to which protein or peptide (e.g., proteins, peptides, subsequences, portions, homologues, variants or derivatives thereof, for example, of any TG protein or sequence set forth herein, such as in as in Table 1 (SEQ ID NOS 1-620), Table 2 (SEQ ID NOS 621-1442), Table 4 (SEQ ID NOS 621-1442) or Table 6, can be immobilized or attached include essentially any physical entity such as a two dimensional surface that is permeable, semi-permeable or impermeable, either rigid or pliable and capable of either storing, binding to or having attached thereto or impregnated.

Substrates include dry solid medium (e.g., cellulose, polyester, nylon, or mixtures thereof etc.), such as glass, silica, plastic, polyethylene, polystyrene, polypropylene, polyacetate, polycarbonate, polyamide, polyester, polyurethane, or polyvinylchloride. Substrates include structures having sections, compartments, wells, containers, vessels or tubes, separated from each other to avoid or prevent cross-contamination or mixing with each other or with other reagents. Multi-well plates, which typically contain 6, 12, 26, 48, 96, to 1000 wells, are one particular non-limiting example of such a structure.

Substrates also include supports used for two- or three-dimensional arrays of sequences. The sequences are typically attached to the surface of the substrate (e.g., via a covalent bond) at defined positions (locations or addresses). Substrates can include a number of sequences, for example, 1, 2, 3, 4, 5, 5 to 10, 10 to 15, 15 to 20, 20 to 25, 25 to 30, 30 to 35, 35 to 40, 40 to 45, 45 to 50, 50 to 75, 75 to 100, 100 to 150, 150 to 200, 200 to 250, 250 to 300, up to all proteins, peptides, subsequences, portions, homologues, variants or derivatives thereof, such as in Table 1 (SEQ ID NOS 1-620), Table 2 (SEQ ID NOS 621-1442), Table 4 (SEQ ID NOS 621-1442) or Table 6. Such substrates, also referred to as "arrays," can have any protein density; the greater the density the greater the number of sequences that can be screened on a given chip. Substrates that include a two- or three-dimensional array of sequences, and individual protein sequences therein, may be coded in accordance with the invention.

The invention also provides nucleic acids encoding proteins, peptides, subsequences, portions, homologues, variants or derivatives thereof, for example, of amino acid sequences set forth in Table 1 (SEQ ID NOS 1-620), Table 2 (SEQ ID NOS 621-1442), Table 4 (SEQ ID NOS 621-1442) or Table 6. Such nucleic acid sequences encode a sequence at least 40% or more (e.g., 45%, 50%, 55%, 60%, 65%, 70%, 75%, 80%, 85%, 90%, 95%, 96%, 97%, 98%, 99%) identical to an exemplary protein, peptide, subsequence, portion, homologue, variant or derivative thereof, for example, of any amino acid sequence set forth in Table 1 (SEQ ID NOS 1-620), Table 2 (SEQ ID NOS 621-1442), Table 4 (SEQ ID NOS 621-1442) or Table 6. In an additional embodiment, a nucleic acid encodes a sequence having a modification, such as one or more amino acid additions (insertions), deletions or substitutions of protein, peptide, subsequence, portion, homologue, variant or derivative thereof, for example, of an amino acid sequence set forth in Table 1 (SEQ ID NOS 1-620), Table 2 (SEQ ID NOS 621-1442), Table 4 (SEQ ID NOS 621-1442) or Table 6.

The terms "nucleic acid," "polynucleotide" and "polynucleoside" and the like refer to at least two or more ribo- or deoxy-ribonucleic acid base pairs (nucleotides/nucleosides) that are linked through a phosphoester bond or equivalent. Nucleic acids include polynucleotides and polynucleotides. Nucleic acids include single, double or triplex, circular or linear, molecules. Exemplary nucleic acids include but are not limited to: RNA, DNA, cDNA, genomic nucleic acid, naturally occurring and non-naturally occurring nucleic acid, e.g., synthetic nucleic acid.

Nucleic acids can be of various lengths. Nucleic acid lengths typically range from about 20 bases to 20 Kilobases (Kb), or any numerical value or range within or encompassing such lengths, 10 bases to 10 Kb, 1 to 5 Kb or less, 1000 to about 500 bases or less in length. Nucleic acids can also be shorter, for example, 100 to about 500 bases, or from about 12 to 24, 24 to 45, 45 to 90, 90 to 250, or about 250 to 500 bases in length, or any numerical value or range or value within or encompassing such lengths. In particular aspects, a nucleic acid sequence has a length from about 10-20, 20-30, 30-50, 50-100, 100-150, 150-200, 200-250, 250-300, 300-400, 400-500, 500-1000, 1000-2000 bases, or any numerical value or range within or encompassing such lengths. Shorter nucleic acids are commonly referred to as "oligonucleotides" or "probes" of single- or double-stranded DNA. However, there is no upper limit to the length of such oligonucleotides.

Nucleic acid sequences further include nucleotide and nucleoside substitutions, additions and deletions, as well as derivatized forms and fusion/chimeric sequences (e.g., encoding recombinant polypeptide). For example, due to the degeneracy of the genetic code, nucleic acids include sequences and subsequences degenerate with respect to nucleic acids that encode proteins, peptides, subsequences, portions, homologues, variants or derivatives thereof, (e.g., substitutions, additions, insertions and deletions), for example, of amino acid sequences set forth in Table 1 (SEQ ID NOS 1-620), Table 2 (SEQ ID NOS 621-1442), Table 4 (SEQ ID NOS 621-1442) or Table 6.

Nucleic acids can be produced using various standard cloning and chemical synthesis techniques. Techniques include, but are not limited to nucleic acid amplification, e.g., polymerase chain reaction (PCR), with genomic DNA or cDNA targets using primers (e.g., a degenerate primer mixture) capable of annealing to the encoding sequence. Nucleic acids can also be produced by chemical synthesis (e.g., solid phase phosphoramidite synthesis) or transcription from a gene. The sequences produced can then be translated in vitro, or cloned into a plasmid and propagated and then expressed in a cell (e.g., a host cell such as eukaryote or mammalian cell, yeast or bacteria, in an animal or in a plant).

Nucleic acid may be inserted into a nucleic acid construct in which expression of the nucleic acid is influenced or regulated by an "expression control element." An "expression control element" refers to a nucleic acid sequence element that regulates or influences expression of a nucleic acid sequence to which it is operatively linked. Expression control elements include, as appropriate, promoters, enhancers, transcription terminators, gene silencers, a start codon (e.g., ATG) in front of a protein-encoding gene, etc.

An expression control element operatively linked to a nucleic acid sequence controls transcription and, as appropriate, translation of the nucleic acid sequence. Expression control elements include elements that activate transcription constitutively, that are inducible (i.e., require an external signal for activation), or derepressible (i.e., require a signal to turn transcription off; when the signal is no longer present, transcription is activated or "derepressed"), or specific for cell-types or tissues (i.e., tissue-specific control elements).

Nucleic acid can also be inserted into a plasmid for propagation into a host cell and for subsequent genetic manipulation. A plasmid is a nucleic acid that can be propagated in a host cell, plasmids may optionally contain expression control elements in order to drive expression of the nucleic acid encoding proteins, peptides, subsequences, portions, homologues, variants or derivatives thereof in the host cell. A vector is used herein synonymously with a plasmid and may also include an expression control element for expression in a host cell (e.g., expression vector). Plasmids and vectors generally contain at least an origin of replication for propagation in a cell and a promoter. Plasmids and vectors are therefore useful for genetic manipulation and expression of proteins, peptides, subsequences, portions, homologues, variants or derivatives thereof, for example, of amino acid sequences set forth in Table 1 (SEQ ID NOS 1-620), Table 2 (SEQ ID NOS 621-1442), Table 4 (SEQ ID NOS 621-1442) or Table 6. Accordingly, vectors that include nucleic acids encoding or complementary to proteins, peptides, subsequences, portions, homologues, variants or derivatives thereof, for example, of amino acid sequences set forth in Table 1 (SEQ ID NOS 1-620), Table 2 (SEQ ID NOS 621-1442), Table 4 (SEQ ID NOS 621-1442) or Table 6, are provided.

In accordance with the invention, there are provided particles (e.g., viral particles) and transformed host cells that express and/or are transformed with a nucleic acid that encodes and/or express proteins, peptides, subsequences, portions, homologues, variants or derivatives thereof, for example, of amino acid sequences set forth in Table 1 (SEQ ID NOS 1-620), Table 2 (SEQ ID NOS 621-1442), Table 4 (SEQ ID NOS 621-1442) or Table 6. Particles and transformed host cells include but are not limited to virions, and prokaryotic and eukaryotic cells such as bacteria, fungi (yeast), plant, insect, and animal (e.g., mammalian, including primate and human, CHO cells and hybridomas) cells. For example, bacteria transformed with recombinant bacteriophage nucleic acid, plasmid nucleic acid or cosmid nucleic acid expression vectors; yeast transformed with recombinant yeast expression vectors; plant cell systems infected with recombinant virus expression vectors (e.g., cauliflower mosaic virus, CaMV; tobacco mosaic virus, TMV) or transformed with recombinant plasmid expression vectors (e.g., Ti plasmid); insect cell systems infected with recombinant virus expression vectors (e.g., baculovirus); and animal cell systems infected with recombinant virus expression vectors (e.g., retroviruses, adenovirus, vaccinia virus), or transformed animal cell systems engineered for stable expression. The cells may be a primary cell isolate, cell culture (e.g., passaged, established or immortalized cell line), or part of a plurality of cells, or a tissue or organ ex vivo or in a subject (in vivo).

The term "transformed" or "transfected" when used in reference to a cell (e.g., a host cell) or organism, means a genetic change in a cell following incorporation of an exogenous molecule, for example, a protein or nucleic acid (e.g., a transgene) into the cell. Thus, a "transfected" or "transformed" cell is a cell into which, or a progeny thereof in which an exogenous molecule has been introduced by the hand of man, for example, by recombinant DNA techniques.

The nucleic acid or protein can be stably or transiently transfected or transformed (expressed) in the host cell and progeny thereof. The cell(s) can be propagated and the introduced protein expressed, or nucleic acid transcribed. A progeny of a transfected or transformed cell may not be identical to the parent cell, since there may be mutations that occur during replication.

Expression of proteins, peptides, subsequences, portions, homologues, variants or derivatives thereof and nucleic acid in particles or introduction into target cells (e.g., host cells) can also be carried out by methods known in the art. Non-limiting examples include osmotic shock (e.g., calcium phosphate), electroporation, microinjection, cell fusion, etc. Introduction of nucleic acid and polypeptide in vitro, ex vivo and in vivo can also be accomplished using other techniques. For example, a polymeric substance, such as polyesters, polyamine acids, hydrogel, polyvinyl pyrrolidone, ethylenevinylacetate, methylcellulose, carboxymethylcellulose, protamine sulfate, or lactide/glycolide copolymers, polylactide/glycolide copolymers, or ethylenevinylacetate copolymers. A nucleic acid can be entrapped in microcapsules prepared by coacervation techniques or by interfacial polymerization, for example, by the use of hydroxymethylcellulose or gelatin-microcapsules, or poly (methylmethacrolate) microcapsules, respectively, or in a colloid system. Colloidal dispersion systems include macromolecule complexes, nano-capsules, microspheres, beads, and lipid-based systems, including oil-in-water emulsions, micelles, mixed micelles, and liposomes.

Liposomes for introducing various compositions into cells are known in the art and include, for example, phosphatidylcholine, phosphatidylserine, lipofectin and DOTAP (e.g., U.S. Pat. Nos. 4,844,904, 5,000,959, 4,863,740, and 4,975,282; and GIBCO-BRL, Gaithersburg, Md.). Piperazine based amphilic cationic lipids useful for gene therapy also are known (see, e.g., U.S. Pat. No. 5,861,397). Cationic lipid systems also are known (see, e.g., U.S. Pat. No. 5,459,127). Polymeric substances, microcapsules and colloidal dispersion systems such as liposomes are collectively referred to herein as "vesicles." Accordingly, viral and non-viral vector means delivery into cells are included.

TG proteins, peptides, subsequences, portions, homologues, variants or derivatives thereof, for example, of TG amino acid sequences set forth in Table 1 (SEQ ID NOS 1-620), Table 2 (SEQ ID NOS 621-1442), Table 4 (SEQ ID NOS 621-1442) or Table 6, are provided, can be employed in various methods and uses. Such methods and uses include, for example, administration in vitro and in vivo of one or more proteins, peptides, subsequences, portions, homologues, variants or derivatives thereof, such as the TG amino acid sequences set forth in Table 1 (SEQ ID NOS 1-620), Table 2 (SEQ ID NOS 621-1442), Table 4 (SEQ ID NOS 621-1442) or Table 6, or subsequences, portions, homologues, variants or derivatives thereof. The methods and uses provided include methods and uses of modulating an immune response, including, among others, methods and uses of protecting and treating subjects against a disorder, disease; and methods and uses of providing specific immunotherapy; and methods and uses of diagnosis.

In particular embodiments, methods and uses include administration or delivery of a protein, peptide, subsequence, portion, homologue, variants or derivative thereof described herein (e.g., of any TG amino acid sequences set forth in Table 1 (SEQ ID NOS 1-620), Table 2 (SEQ ID NOS 621-1442), Table 4 (SEQ ID NOS 621-1442) or Table 6) to modulate an immune response in a subject, including, for example, modulating an immune response to an allergen or antigen.

As used herein, the term "modulate," means an alteration or effect on the term modified. For example, the term modulate can be used in various contexts to refer to an alteration or effect of an activity, a function, or expression of a polypeptide, gene or signaling pathway, or a physiological condition or response of an organism. In certain embodiments, modulating involves decreasing, reducing, inhibiting, suppressing or disrupting an immune response of a subject to an antigen or allergen. In other embodiments, modulating involves eliciting, stimulating, inducing, promoting, increasing or enhancing an immune response of a subject to an antigen or allergen. Thus, where the term "modulate" is used to modify the term "immune response against an allergen in a subject" this means that the immune response in the subject to the allergen is altered or affected (e.g., decreased, reduced, inhibited, suppressed, limited, controlled, prevented, elicited, promoted, stimulated, increased, induced, enhanced, etc.).

Methods and uses of modulating an immune response against an antigen or allergen as described herein may be used to provide a subject with protection against an allergic response or reaction to the allergen, or allergic disorder or allergic disease, or one or more physiological conditions, disorders, illnesses, diseases, symptoms or complications caused by or associated with the allergen. Accordingly, in other embodiments, methods and uses include administering a protein, peptide, subsequence, portion, homologue, variant or derivative thereof described herein (e.g., of any TG amino acid sequences set forth in Table 1 (SEQ ID NOS 1-620), Table 2 (SEQ ID NOS 621-1442), Table 4 (SEQ ID NOS 621-1442) or Table 6) to protect or treat a subject against an allergic response, allergic disorder or allergic disease, or one or more physiological conditions, disorders, illnesses, diseases, symptoms or complications caused by or associated with an allergen. In still other embodiments, methods and uses include administering or delivering a protein, peptide, subsequence, portion, homologue, variant or derivative thereof described herein (e.g., of any TG amino acid sequences set forth in Table 1 (SEQ ID NOS 1-620), Table 2 (SEQ ID NOS 621-1442), Table 4 (SEQ ID NOS 621-1442) or Table 6) to elicit, stimulate, induce, promote, increase or enhance immunological tolerance of a subject to an antigen or allergen.

In various embodiments, there are provided methods and uses of providing a subject with protection against an allergic response, allergic disorder or allergic disease, or one or more physiological conditions, disorders, illnesses, diseases, symptoms or complications caused by or associated with an allergen. In various aspects, a method or use includes administering to the subject an amount of a protein, peptide, subsequence, portion, homologue, variant or derivative thereof described herein (e.g., of any TG amino acid sequences set forth in Table 1 (SEQ ID NOS 1-620), Table 2 (SEQ ID NOS 621-1442), Table 4 (SEQ ID NOS 621-1442) or Table 6) sufficient to provide the subject with protection against the allergic response, allergic disorder or allergic disease, or one or more physiological conditions, disorders, illnesses, diseases, symptoms or complications caused by or associated with the allergen.

Methods and uses of the invention include providing a subject with protection against an antigen or allergen, or one or more physiological conditions, disorders, illnesses, diseases, symptoms or complications caused by or associated with the exposure to the antigen or allergen, for example, vaccinating the subject to protect against an allergic response to the allergen, for example with any TG amino acid sequences set forth in Table 1 (SEQ ID NOS 1-620), Table 2 (SEQ ID NOS 621-1442), Table 4 (SEQ ID NOS 621-1442) or Table 6. In certain embodiments, methods and uses include protecting the subject against an allergic response or reaction by inducing tolerance of the subject (desensitizing) to the allergen.

As used herein, the terms "protection," "protect" and grammatical variations thereof, when used in reference to an allergic response or one or more physiological conditions, disorders, illnesses, diseases, symptoms or complications caused by or associated with the exposure to allergen, means preventing an allergic response, reaction, or one or more physiological conditions, disorders, illnesses, diseases, symptoms or complications caused by or associated with the exposure to the allergen, or reducing or decreasing susceptibility to an allergic response, reaction, or one or more physiological conditions, disorders, illnesses, diseases, symptoms or complications caused by or associated with the exposure to the allergen.

An allergic response includes but is not limited to an allergic reaction, hypersensitivity, an inflammatory response or inflammation. In certain embodiments allergic response may involve one or more of cell infiltration, production of antibodies, production of cytokines, lymphokines, chemokines, interferons and interleukins, cell growth and maturation factors (e.g., differentiation factors), cell proliferation, cell differentiation, cell accumulation or migration (chemotaxis) and cell, tissue or organ damage or remodeling. In particular aspects, an allergic response may include Allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy.

Allergic responses can occur systemically, or locally in any region, organ, tissue, or cell. In particular aspects, an allergic response occurs in the skin, the upper respiratory tract, the lower respiratory tract, pancreas, thymus, kidney, liver, spleen, muscle, nervous system, skeletal joints, eye, mucosal tissue, gut or bowel.

Methods and uses herein include treating a subject for an allergic response, allergic disorder or allergic disease, as well as one or more physiological conditions, disorders, illnesses, diseases, symptoms or complications caused by or associated with an allergen. Such methods and uses include administering to a subject an amount of a protein, peptide, subsequence, portion, homologue, variant or derivative thereof described herein (e.g., any TG amino acid sequences set forth in Table 1 (SEQ ID NOS 1-620), Table 2 (SEQ ID NOS 621-1442), Table 4 (SEQ ID NOS 621-1442) or Table 6) sufficient to treat the subject for the allergic response, allergic disorder or allergic disease, or one or more physiological conditions, disorders, illnesses, diseases, symptoms or complications caused by or associated with the allergen.

As will be understood by a person skilled in the art, treating an allergic response, allergic disorder or allergic disease, or one or more physiological conditions, disorders, illnesses, diseases, symptoms or complications caused by or associated with an allergen may include decreasing, reducing, inhibiting, suppressing, limiting, controlling or clearing an allergic response, an allergic disorder or allergic disease, or one or more physiological conditions, disorders, illnesses, diseases, symptoms or complications caused by or associated with the allergen. Thus in certain embodiments, a method or use of treating a subject for a an allergic response, allergic disorder or allergic disease, or one or more physiological conditions, disorders, illnesses, diseases, symptoms or complications caused by or associated with an allergen comprises elimination of the allergic response, allergic disorder or allergic disease, or one or more physiological conditions, disorders, illnesses, diseases, symptoms or complications caused by or associated with the allergen from a subject. In other embodiments, a method or use of treating a subject for an allergic response, allergic disorder or allergic disease, or one or more physiological conditions, disorders, illnesses, diseases, symptoms or complications caused by or associated with an allergen includes reducing occurrence, frequency, severity, progression, or duration of the allergic response, allergic disorder or allergic disease, or one or more physiological conditions, disorders, illnesses, diseases, symptoms or complications caused by or associated with the allergen in the subject. In yet another embodiment, a method or use of treating a subject for an allergic response, allergic disorder or allergic disease, or one or more physiological conditions, disorders, illnesses, diseases, symptoms or complications caused by or associated with an allergen, includes stabilizing the allergic response, allergic disorder or allergic disease, or one or more physiological conditions, disorders, illnesses, diseases, symptoms or complications caused by or associated with the allergen in a subject by preventing an increase in the occurrence, frequency, severity, progression, or duration of the allergic response, allergic disorder or allergic disease, or one or more physiological conditions, disorders, illnesses, diseases, symptoms or complications caused by or associated with contact of the subject with an allergen.

Methods and uses of the invention include treating or administering a subject previously exposed to an antigen or allergen. Thus, in certain embodiments, methods and uses are for treating or protecting a subject from an allergic response, allergic disorder or allergic disease, or one or more physiological conditions, disorders, illnesses, diseases, symptoms or complications caused by or associated with secondary or subsequent exposure to an antigen or allergen.

Physiological conditions, disorders, illnesses, diseases, symptoms or complications caused by or associated with an antigen/allergen treatable in accordance with the invention methods and uses include but are not limited to asthma, allergic asthma, bronchiolitis and pleuritis, Allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy, Airway Obstruction, Apnea, Asbestosis, Atelectasis, Berylliosis, Bronchiectasis, Bronchiolitis, Bronchiolitis Obliterans Organizing Pneumonia, Bronchitis, Bronchopulmonary Dysplasia, Empyema, Pleural Empyema, Pleural Epiglottitis, Hemoptysis, Hypertension, Kartagener Syndrome, Meconium Aspiration, Pleural Effusion, Pleurisy, Pneumonia, Pneumothorax, Respiratory Distress Syndrome, Respiratory Hypersensitivity, Rhinoscleroma, Scimitar Syndrome, Severe Acute Respiratory Syndrome, Silicosis, Tracheal Stenosis, eosinophilic pleural effusions, Histiocytosis; chronic eosinophilic pneumonia; hypersensitivity pneumonitis; Allergic bronchopulmonary aspergillosis; Sarcoidosis; Idiopathic pulmonary fibrosis; pulmonary edema; pulmonary embolism; pulmonary emphysema; Pulmonary Hyperventilation; Pulmonary Alveolar Proteinosis; Chronic Obstructive Pulmonary Disease (COPD); Interstitial Lung Disease; and Topical eosinophilia.

Timothy grass proteins, peptides, subsequences, portions, homologues, variants and derivatives thereof, described herein may elicit, stimulate, induce, promote, increase or enhance immunological tolerance to an antigen, including an allergen. Methods and uses of the invention therefore further include inducing immunological tolerance of a subject to an antigen or allergen. Thus, for example, Timothy grass proteins, peptides, subsequences, portions, homologues, variants and derivatives thereof, described herein can be effective in treatment (e.g., therapeutic) of an allergic immune response, including but not limited to an allergic immune response following a secondary or subsequent exposure of a subject to an antigen. In one embodiment, a method or use includes administering to the subject an amount of a protein, peptide, subsequence, portion, homologue, variant or derivative thereof described herein (e.g., any TG amino acid sequences set forth in Table 1 (SEQ ID NOS 1-620), Table 2 (SEQ ID NOS 621-1442), Table 4 (SEQ ID NOS 621-1442) or Table 6) sufficient to induce tolerance in the subject to the antigen or allergen. In particular aspects, the immunological tolerance elicited, stimulated, induced, promoted, increased or enhanced may involve modulation of T cell activity, including but not limited to CD4+ T cells, CD8+ T cells, Th1 cells, Th2 cells and regulatory T cells. For example, immunological tolerance elicited, stimulated, induced, promoted, increased or enhanced from administration of the Timothy grass proteins or peptides, or subsequence, portion, homologue, variant or derivative thereof, may involve modulation of the production or activity of pro-inflammatory or anti-inflammatory cytokines produced by T cells.

In additional embodiments, a method or use of inducing immunological tolerance in a subject to an allergen includes a reduction in occurrence, frequency, severity, progression, or duration of physiological conditions, disorders, illnesses, diseases, symptoms or complications caused by or associated an allergic response to the allergen in the subject. Thus, in certain embodiments, inducing immunological tolerance can protect a subject against or treat a subject for an allergic response, allergic disorder or allergic disease, or one or more physiological conditions, disorders, illnesses, diseases, symptoms or complications caused by or associated with an antigen or allergen.

Methods and uses of inducing immunological tolerance described herein may include eliciting, stimulating, inducing, promoting, increasing or enhancing an immune response. In certain embodiments, inducing immunological tolerance may include eliciting, stimulating, inducing, promoting, increasing or enhancing an immune response that decreases, reduces, inhibits, suppresses, limits, controls or clears an allergic response. For example, in certain embodiments inducing immunological tolerance may include eliciting, stimulating, inducing, promoting, increasing or enhancing proliferation or activity of regulatory T cells. In other embodiments, inducing immunological tolerance may include eliciting, stimulating, inducing, promoting, increasing or enhancing an immune response that promotes an allergic response. As will be understood by a person of skill in the art, a method or use that elicits, stimulates, induces, promotes, increases or enhances an immune response that promotes an allergic response may still induce immunological tolerance by also eliciting, stimulating, inducing, promoting, increasing or enhancing an immune response that decreases, reduces, inhibits, suppresses, limits, controls or clears an allergic response. In particular embodiments, inducing immunological tolerance includes eliciting, stimulating, inducing, promoting, increasing or enhancing an immune responses that decreases, reduces, inhibits, suppresses, limits, controls or clears an allergic response that is stronger than the immune response that promotes an allergic response. In other embodiments, inducing immunological tolerance includes eliciting, stimulating, inducing, promoting, increasing or enhancing more immune responses that decrease, reduce, inhibit, suppress, limit, controls or clear an allergic response than immune responses that promote an allergic response.

Methods and uses of the invention include treating a subject via specific immunotherapy. In one embodiment, a method or use includes administering to the subject an amount of a protein, peptide, subsequence, portion, homologue, variant or derivative thereof described herein (e.g., any TG amino acid sequences set forth in Table 1 (SEQ ID NOS 1-620), Table 2 (SEQ ID NOS 621-1442), Table 4 (SEQ ID NOS 621-1442) or Table 6. In one aspect, an antigen (allergen) administered to a subject during specific immunotherapy to treat the subject is the same antigen (allergen) to which the subject has been sensitized or is hypersensitive (e.g., allergic). In another non-limiting aspect, an antigen (allergen) administered to a subject to treat the subject is a different antigen (allergen) to which the subject has been sensitized or is hypersensitive (e.g., allergic). Thus in different embodiments, the antigen administered and antigen (e.g., allergen) against which immunological tolerance is sought may be the same protein (antigen, allergen), may be proteins (antigens, allergens) of the same organism or may be proteins (antigens, allergens) of different organisms.

In accordance with the invention, methods and uses include therapeutic (following antigen/allergen exposure) and prophylactic (prior to antigen/allergen exposure) uses and methods. For example, therapeutic and prophylactic methods and uses of treating a subject for an allergic response, allergic disorder or allergic disease, or one or more physiological conditions, disorders, illnesses, diseases, symptoms or complications caused by or associated with an allergen, include but are not limited to treatment of a subject having or at risk of having an allergic response, allergic disorder or allergic disease, or one or more physiological conditions, disorders, illnesses, diseases, symptoms or complications caused by or associated with an allergen; treating a subject with an allergic response, allergic disorder or allergic disease, or one or more physiological conditions, disorders, illnesses, diseases, symptoms or complications caused by or associated with an allergen; and methods and uses of protecting a subject from an allergic response, allergic disorder or allergic disease, or one or more physiological conditions, disorders, illnesses, diseases, symptoms or complications caused by or associated with an antigen/allergen (e.g., provide the subject with protection against an allergic reaction to an allergen), to decrease or reduce the probability of an allergic response, allergic disorder or allergic disease, or one or more physiological conditions, disorders, illnesses, diseases, symptoms or complications caused by or associated with an allergen, in a subject and to decrease or reduce susceptibility of a subject to an allergic response, allergic disorder or allergic disease, or one or more physiological conditions, disorders, illnesses, diseases, symptoms or complications caused by or associated with an allergen, to inhibit or prevent an allergic response, allergic disorder or allergic disease, or one or more physiological conditions, disorders, illnesses, diseases, symptoms or complications caused by or associated with an allergen, in a subject. Accordingly, methods and uses can treat an allergic response, allergic disorder or allergic disease, or one or more physiological conditions, disorders, illnesses, diseases, symptoms or complications caused by or associated with an allergen, or provide a subject with protection from an allergic response, allergic disorder or allergic disease, or one or more physiological conditions, disorders, illnesses, diseases, symptoms or complications caused by or associated with an allergen (e.g., prophylactic protection).

As described herein, proteins, peptides, subsequences, portions, homologues, variants and derivatives thereof include T cell epitopes, such as Th2 cell epitopes. Accordingly, methods and uses of the invention include administering an amount of a protein, peptide, subsequence, portion, homologue, variant or derivative thereof (e.g., a T cell epitope) to a subject sufficient to provide the subject with protection against an allergic response, allergic disorder or allergic disease, or one or more physiological conditions, disorders, illnesses, diseases, symptoms or complications caused by or associated with an allergen. In another embodiment, a method includes administering an amount of a protein, peptide, subsequence, portion, homologue, variant or derivative thereof (e.g., a T cell epitope, such as a Th2 cell epitope) to a subject sufficient to treat, vaccinate or immunize the subject against an allergic response, allergic disorder or allergic disease, or one or more physiological conditions, disorders, illnesses, diseases, symptoms or complications caused by or associated with an allergen.

In accordance with the invention, methods and uses of modulating anti-allergen activity of T cells, including but not limited to CD8$^+$ T cells, CD4$^+$ T cells, Th1 cells or Th2 cells, in a subject are provided. In one embodiment, a method or use includes administering to a subject an amount of a protein, peptide, subsequence, portion, homologue, variant or derivative thereof, such as a T cell epitope, sufficient to modulate Th2 cell activity in the subject.

In all methods and uses of the invention, any appropriate protein, peptide, subsequence, portion, homologue, variant or derivative thereof can be used or administered. In particular non-limiting examples, the protein, peptide, subsequence, portion, homologue, variant or derivative thereof comprises, consists of or consists essentially of a TG amino acid sequence of a protein or peptide set forth in in Table 1 (SEQ ID NOS 1-620), Table 2 (SEQ ID NOS 621-1442), Table 4 (SEQ ID NOS 621-1442) or Table 6, or a subsequence, portion, homologue, variant or derivative thereof.

In certain embodiments, two or more proteins, peptides, subsequences, portions, homologues, variants or derivatives thereof, may be administered to a subject. In particular embodiments, a protein, peptide, subsequence, portion, homologue, variant or derivative thereof consists of or consists essentially of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6, or subsequence, portion, homologue, variant or derivative thereof, and is administered with one or more other proteins, peptides, subsequences, portions, homologues, variants or derivatives thereof. Two or more proteins, peptides, subsequences, portions, homologues, variants or derivatives thereof may be administered as a combination composition, or administered separately, such as concurrently or in series or sequentially. Different proteins, peptides, subsequences, portions, homologues, variants or derivatives thereof, may be administered to a subject in the same amount, volume or concentration, or different amounts, volumes or concentrations. Thus, in certain embodiments, the subject may be administered the same amount of two or more different proteins, peptides, subsequences, portions, homologues, variants or derivatives thereof; and in other embodiments, the subject may be administered one protein, peptide, subsequence, portion, homologue, variant or derivative thereof in an amount, volume or concentration greater than one or more other protein, peptide, subsequence, portion, homologue, variant or derivative thereof administered to the subject.

Methods and uses of the invention include a favorable response or an improvement in one or more physiological conditions, disorders, illnesses, diseases, symptoms or complications caused by or associated with an antigen/allergen. In particular embodiments, a favorable response or improvement includes but is not limited to reduce, decrease, suppress, limit, control or inhibit an allergic response including reducing, decreasing, suppressing, limiting, controlling or inhibiting immune cell proliferation, function or activity, or eliciting, stimulating, inducing, promoting, increasing or enhancing immune cell proliferation or activity (e.g. regulatory T cells); or reduce, decrease, suppress, limit, control or inhibit the amount of allergen. In additional particular embodiments, an amount of a protein, peptide, subsequence, portion, homologue, variant or derivative thereof is sufficient to elicit, stimulate, induce, promote, increase or enhance or augment immunological tolerance to an allergen; or decrease, reduce, inhibit, suppress, prevent, control, or limit an allergic reaction or response. In further particular embodiments, an amount of a protein, peptide, subsequence, portion, homologue, variant or derivative thereof is sufficient to protect a subject from an allergic response or reduce, decrease, limit, control or inhibit susceptibility to an allergic response, allergic disorder or allergic disease, or one or more physiological conditions, disorders, illnesses, diseases, symptoms or complications caused by or associated with an allergen.

Methods and uses of the invention therefore include any therapeutic or beneficial effect. In various methods embodiments, an allergic response, allergic disorder or allergic disease, or one or more physiological conditions, disorders, illnesses, diseases, symptoms or complications caused by or associated with an allergen is reduced, decreased, inhibited, limited, delayed or prevented. Physiological conditions, disorders, illnesses and diseases associated with an antigen/allergen include but are not limited to asthma, allergic asthma, bronchiolitis and pleuritis, Allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy, Airway Obstruction, Apnea, Asbestosis, Atelectasis, Berylliosis, Bronchiectasis, Bronchiolitis, Bronchiolitis Obliterans Organizing Pneumonia, Bronchitis, Bronchopulmonary Dysplasia, Empyema, Pleural Empyema, Pleural Epiglottitis, Hemoptysis, Hypertension, Kartagener Syndrome, Meconium Aspiration, Pleural Effusion, Pleurisy, Pneumonia, Pneumothorax, Respiratory Distress Syndrome, Respiratory Hypersensitivity, Rhinoscleroma, Scimitar Syndrome, Severe Acute Respiratory Syndrome, Silicosis, Tracheal Stenosis, eosinophilic pleural effusions, Histiocytosis; chronic eosinophilic pneumonia; hypersensitivity pneumonitis; Allergic bronchopulmonary aspergillosis; Sarcoidosis; Idiopathic pulmonary fibrosis; pulmonary edema; pulmonary embolism; pulmonary emphysema; Pulmonary Hyperventilation; Pulmonary Alveolar Proteinosis; Chronic Obstructive Pulmonary Disease (COPD); Interstitial Lung Disease; and Topical eosinophilia. Symptoms and complications associated with an allergen include but are not limited to cell infiltration, production of antibodies, production of cytokines, lymphokines, chemokines, interferons and interleukins, cell growth and maturation factors (e.g., differentiation factors), cell proliferation, cell differentiation, cell accumulation or migration and cell, tissue or organ damage or remodelling, allergic rhinitis; Onchocercal dermatitis; Atopic dermatitis;

allergic conjunctivitis; Drug reactions; Nodules, eosinophilia, rheumatism, dermatitis, rashes, hives, and swelling (NERDS); esophageal and a gastrointestinal allergy. Additional symptoms of antigen/allergen exposure are known to one of skill in the art and treatment thereof in accordance with the invention is provided.

Methods and uses of the invention moreover include reducing, decreasing, inhibiting, delaying or preventing onset, progression, frequency, duration, severity, probability or susceptibility of one or more adverse symptoms, disorders, illnesses, diseases or complications caused by or associated with an antigen/allergen. In further various particular embodiments, methods and uses include improving, accelerating, facilitating, enhancing, augmenting, or hastening recovery of a subject from an allergic response, allergic disorder or allergic disease, or one or more physiological conditions, disorders, illnesses, diseases, symptoms or complications caused by or associated with an antigen/allergen. In yet additional various embodiments, methods and uses include stabilizing an allergic response, allergic disorder or allergic disease, or one or more physiological conditions, disorders, illnesses, diseases, symptoms or complications caused by or associated with an antigen/allergen.

A therapeutic or beneficial effect is therefore any objective or subjective measurable or detectable improvement or benefit provided to a particular subject. A therapeutic or beneficial effect can but need not be complete ablation of all or any allergic response, allergic disorder or allergic disease, or one or more physiological conditions, disorders, illnesses, diseases, symptoms or complications caused by or associated with an allergen. Thus, a satisfactory clinical endpoint is achieved when there is an incremental improvement or a partial reduction in an allergic response, allergic disorder or allergic disease, or one or more physiological conditions, disorders, illnesses, diseases, symptoms or complications caused by or associated with an allergen, or an inhibition, decrease, reduction, suppression, prevention, limit or control of worsening or progression of an allergic response, allergic disorder or allergic disease, or one or more physiological conditions, disorders, illnesses, diseases, symptoms or complications caused by or associated with an allergen, over a short or long duration (hours, days, weeks, months, etc.).

A therapeutic or beneficial effect also includes reducing or eliminating the need, dosage frequency or amount of a second therapeutic protocol or active such as another drug or other agent (e.g., anti-inflammatory) used for treating a subject having or at risk of having an allergic response, allergic disorder or allergic disease, or one or more physiological conditions, disorders, illnesses, diseases, symptoms or complications caused by or associated with an allergen. For example, reducing an amount of an adjunct therapy, such as a reduction or decrease of a treatment for an allergic response, allergic disorder or allergic disease, or one or more physiological conditions, disorders, illnesses, diseases, symptoms or complications caused by or associated with an allergen, or a specific immunotherapy, vaccination or immunization protocol is considered a beneficial effect. In addition, reducing or decreasing an amount of protein, peptide, subsequence, portion, homologue, variant or derivative thereof, used for specific immunotherapy, vaccination or immunization of a subject to provide protection to the subject is considered a beneficial effect.

As disclosed herein, invention proteins, peptides, subsequences, etc., can be used in methods of providing specific immunotherapy to a subject, such as a subject with or at risk of an allergic response, allergic disorder or allergic disease, or one or more physiological conditions, disorders, illnesses, diseases, symptoms or complications caused by or associated with an allergen. In one embodiment, a method or use includes administering to a subject an amount of a protein, peptide, subsequence, portion, homologue, variant or derivative thereof sufficient to elicit, stimulate, induce, promote, increase, enhance or augment immunological tolerance in the subject to an antigen/allergen. In another embodiment, a method includes administering to a subject an amount of a nucleic acid encoding all or a portion (e.g., a T cell epitope) of a protein, peptide, subsequence, portion, homologue, variant or derivative thereof sufficient to elicit, stimulate, induce, promote, increase, enhance or augment immunological tolerance of the subject to an allergen.

When an antigen(s) or allergen(s) is administered to induce tolerance, an amount or dose of the antigen or allergen to be administered, and the period of time required to achieve a desired outcome or result (e.g., to desensitize or develop tolerance to the antigen or allergen) can be determined by one skilled in the art. The antigen or allergen may be administered to the patient through any route known in the art, including, but not limited to oral, inhalation, sublingual, epicutaneous, intranasal, and/or parenteral routes (intravenous, intramuscular, subcutaneously, and intraperitoneal).

Methods and uses of the invention include administration of a protein, peptide, subsequence, portion, homologue, variant or derivative thereof to a subject prior to contact by or exposure to an allergen; administration prior to, substantially contemporaneously with or after a subject has been contacted by or exposed to an allergen; and administration prior to, substantially contemporaneously with or after an allergic response, allergic disorder or allergic disease, or one or more physiological conditions, disorders, illnesses, diseases, symptoms or complications caused by or associated with an allergen. A subject contacted by or exposed to an allergen may have contact or exposure over a period of 1-5, 5-10, 10-20, 20-30, 30-50, 50-100 hours, days, months, or years.

Invention compositions (e.g., proteins, peptides, subsequences, portions, homologues, variants or derivatives thereof, including T cell epitopes, for example, of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6), methods and uses can be combined with any compound, agent, drug, treatment or other therapeutic regimen or protocol having a desired therapeutic, beneficial, additive, synergistic or complementary activity or effect. Exemplary combination compositions and treatments include multiple proteins, peptides, subsequences, portions, homologues, variants or derivatives thereof such as T cell epitopes as described herein (e.g., of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6), and second actives, such as anti-allergen compounds, agents, drugs, treatments and therapies, including but not limited to anti-histamines, anti-inflammatories, decongestants and corticosteroids as well as agents that assist, promote, stimulate or enhance efficacy. Such anti-allergen drugs, agents, treatments and therapies can be administered or performed prior to, substantially contemporaneously with or following any method or use described herein, for example, a therapeutic use or method of treating a subject for an allergic response, allergic disorder or allergic disease, or one or more physiological conditions, disorders, illnesses, diseases, symptoms or complications caused by or associated with an allergen, or a method or use of providing specific immunotherapy to a subject.

Accordingly, methods and uses include combinations of TG proteins, peptides, subsequences, portions, homologues, variants or derivatives thereof and second actives, and administering as a combination with a second active, or administered separately, such as concurrently or in series or sequentially (prior to or following) to administering a second active to a subject. The invention therefore provides combinations of one or more proteins, peptides, subsequences, portions, homologues, variants or derivatives thereof, in combination with a second active, including but not limited to any compound, agent, drug, therapeutic regimen, treatment protocol, process, remedy or composition, such as anti-histamine, anti-inflammatory, decongestant and corticosteroid, or immune tolerance stimulating, enhancing or augmenting protocol, or specific immunotherapy protocol set forth herein or known in the art. The compound, agent, drug, therapeutic regimen, treatment protocol, process, remedy or composition can be administered or performed prior to, substantially contemporaneously with or following administration of one or more proteins, peptides, subsequences, portions, homologues, variants or derivatives thereof, or a nucleic acid encoding all or a portion (e.g., a T cell epitope) of a protein, peptide, subsequence, portion, homologue, variant or derivative thereof, to a subject. Specific non-limiting examples of combination embodiments therefore include the foregoing or other compound, agent, drug, therapeutic regimen, treatment protocol, process, remedy or composition.

An exemplary combination is a TG protein, peptide, subsequence, portion, homologue, variant or derivative thereof, and a different protein, peptide, or subsequence, portion, homologue, variant or derivative thereof, of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6. Another exemplary combination is a protein, peptide, subsequence, portion, homologue, variant or derivative thereof, and an immunological tolerance inducing molecule.

In invention methods and uses in which there is a desired outcome or effect, such as a therapeutic or prophylactic method or use that provides a benefit from treatment, protection, inducing immunological tolerance, vaccination or specific immunotherapy, a TG protein, peptide, subsequence, portion, homologue, variant or derivative thereof can be administered in a sufficient or effective amount. As used herein, a "sufficient amount" or "effective amount" or an "amount sufficient" or an "amount effective" refers to an amount that provides, in single (e.g., primary) or multiple (e.g., booster) doses, alone or in combination with one or more other compounds, treatments, therapeutic regimens or agents (e.g., a drug), a long term or a short term detectable or measurable improvement in a given subject or any objective or subjective benefit to a given subject of any degree or for any time period or duration (e.g., for minutes, hours, days, months, years, or cured).

An amount sufficient or an amount effective can but need not be provided in a single administration and can but need not be achieved by a particular protein, peptide, subsequence, portion, homologue, variant or derivative thereof, alone, optionally in a combination composition or method or use that includes a second active. In addition, an amount sufficient or an amount effective need not be sufficient or effective if given in single or multiple doses without a second or additional administration or dosage, since additional doses, amounts or duration above and beyond such doses, or additional antigens, compounds, drugs, agents, treatment or therapeutic regimens may be included in order to provide a given subject with a detectable or measurable improvement or benefit to the subject. For example, to increase, enhance, improve or optimize specific immunotherapy, after an initial or primary administration of one or more proteins, peptides, subsequences, portions, homologues, variants or derivative thereof, the subject can be administered one or more additional "boosters" of one or more proteins, peptides, subsequences, portions, homologues, variants or derivatives thereof. Such subsequent "booster" administrations can be of the same or a different type, formulation, dose, concentration, route, etc.

An amount sufficient or an amount effective need not be therapeutically or prophylactically effective in each and every subject treated, nor a majority of subjects treated in a given group or population. An amount sufficient or an amount effective means sufficiency or effectiveness in a particular subject, not a group of subjects or the general population. As is typical for such methods, different subjects will exhibit varied responses to a method of the invention, such as immunization, vaccination, specific immunotherapy and therapeutic treatments.

The term "subject" includes but is not limited to a subject at risk of allergen contact or exposure as well as a subject that has been contacted by or exposed to an allergen. A subject also includes those having or at risk of having or developing an immune response to an antigen or an allergen. Such subjects include mammalian animals (mammals), such as a non-human primate (apes, gibbons, gorillas, chimpanzees, orangutans, macaques), a domestic animal (dogs and cats), a farm animal (poultry such as chickens and ducks, horses, cows, goats, sheep, pigs), experimental animal (mouse, rat, rabbit, guinea pig) and humans. Subjects include animal disease models, for example, mouse and other animal models of allergic response known in the art.

Accordingly, subjects appropriate for treatment include those having or at risk of exposure to an antigen or allergen, also referred to as subjects in need of treatment. Subjects in need of treatment therefore include subjects that have been exposed to or contacted with an antigen or allergen, or that have an ongoing contact or exposure or have developed one or more adverse symptoms caused by or associated with an antigen or allergen, regardless of the type, timing or degree of onset, progression, severity, frequency, duration of the symptoms.

Target subjects and subjects in need of treatment also include those at risk of allergen exposure or contact or at risk of having exposure or contact to an allergen. Accordingly, subjects include those at increased or elevated (high) risk of an allergic reaction; has, or has previously had or is at risk of developing hypersensitivity to an allergen; and those that have or have previously had or is at risk of developing asthma.

More particular target subjects include subjects allergic to particular Timothy Grass antigens and/or allergens. In particular embodiments, a subject is allergic to a Timothy grass pollen allergen, such as a Phl p 1, Phl p 5, and/or Phl p 6 allergen, or is allergic to a homologous allergen, such as a Group 1, Group 5 and/or Group 6 Grass Pollen allergen, e.g. Grass Pollen from Grass of the order Poales.

Invention compositions, methods and uses are therefore applicable to treating a subject who is at risk of allergen exposure or contact but has not yet been exposed to or contacted with the allergen. Prophylactic uses and methods are therefore included. Target subjects for prophylaxis may be at increased risk (probability or susceptibility) of allergen exposure or contact as set forth herein. Such subjects are considered in need of treatment due to being at risk.

Subjects for prophylaxis need not be at increased risk but may be from the general population in which it is desired to protect a subject against an allergic response, allergic disorder or allergic disease, or one or more physiological conditions, disorders, illnesses, diseases, symptoms or complications caused by or associated with an allergen or to provide specific immunotherapy, for example. Such a subject that is desired to be protected against an allergic response, allergic disorder or allergic disease, or one or more physiological conditions, disorders, illnesses, diseases, symptoms or complications caused by or associated with an allergen or to be provided specific immunotherapy can be administered a protein, peptide, subsequence, portion, homologue, variant or derivative thereof. In another non-limiting example, a subject that is not specifically at risk of exposure to or contact by an allergen, but nevertheless desires protection against an allergic response, allergic disorder or allergic disease, or one or more physiological conditions, disorders, illnesses, diseases, symptoms or complications caused by or associated with an allergen, can be administered a protein, peptide, subsequence, portion, homologue, variant or derivative thereof. Such subjects are also considered in need of treatment.

"Prophylaxis" and grammatical variations thereof mean a method or use in which contact, administration or in vivo delivery to a subject is prior to contact with or exposure to an allergen. In certain situations it may not be known that a subject has been contacted with or exposed to an allergen, but administration or in vivo delivery to a subject can be performed prior to manifestation of an allergic response, allergic disorder or allergic disease, or one or more physiological conditions, disorders, illnesses, diseases, symptoms or complications caused by or associated with an allergen. For example, a subject can be provided protection against an allergic response, allergic disorder or allergic disease, or one or more physiological conditions, disorders, illnesses, diseases, symptoms or complications caused by or associated with an allergen or provided specific immunotherapy with a protein, peptide, subsequence, portion, homologue, variant or derivative thereof. In such case, a method or use can eliminate, prevent, inhibit, suppress, limit, decrease or reduce the probability of or susceptibility towards an allergic response, allergic disorder or allergic disease, or one or more physiological conditions, disorders, illnesses, diseases, symptoms or complications caused by or associated with an antigen/allergen.

"Prophylaxis" can also refer to a method or use in which contact, administration or in vivo delivery to a subject is prior to a secondary or subsequent exposure to an antigen/allergen. In such a situation, a subject may have had a prior contact or exposure to an allergen. In such subjects, an acute allergic reaction may but need not be resolved. Such a subject typically may have developed anti-allergen antibodies due to the prior exposure. Immunization or vaccination, by administration or in vivo delivery to such a subject, can be performed prior to a secondary or subsequent allergen exposure. Such a method or use can eliminate, prevent, inhibit, suppress, limit, decrease or reduce the probability of or susceptibility towards a secondary or subsequent allergic response, allergic disorder or allergic disease, or one or more physiological conditions, disorders, illnesses, diseases, symptoms or complications caused by or associated with an allergen. In certain embodiments, such a method or use includes providing specific immunotherapy to the subject to eliminate, prevent, inhibit, suppress, limit, decrease or reduce the probability of or susceptibility towards a secondary or subsequent allergic response, allergic disorder or allergic disease, or one or more physiological conditions, disorders, illnesses, diseases, symptoms or complications caused by or associated with an antigen/allergen.

Treatment of an allergic reaction or response can be at any time during the reaction or response. A protein, peptide, subsequence, portion, homologue, variant or derivative thereof, can be administered as a combination (e.g., with a second active), or separately concurrently or in sequence (sequentially) in accordance with the methods and uses described herein as a single or multiple dose e.g., one or more times hourly, daily, weekly, monthly or annually or between about 1 to 10 weeks, or for as long as appropriate, for example, to achieve a reduction in the onset, progression, severity, frequency, duration of one or more symptoms or complications associated with or caused by an allergic response, allergic disorder or allergic disease, or one or more physiological conditions, disorders, illnesses, diseases, symptoms or complications caused by or associated with an antigen/allergen.

Accordingly, methods and uses of the invention can be practiced one or more times (e.g., 1-10, 1-5 or 1-3 times) an hour, day, week, month, or year. The skilled artisan will know when it is appropriate to delay or discontinue administration. A non-limiting dosage schedule is 1-7 times per week, for 1, 2, 3, 4, 5, 6, 7, 8, 9, 10, 15, 20 or more weeks.

Doses can be based upon current existing protocols, empirically determined, using animal disease models or optionally in human clinical trials. Initial study doses can be based upon animal studies, e.g. a mouse, and the amount of protein, peptide, subsequence, portion, homologue, variant or derivative thereof, administered that is determined to be effective. Exemplary non-limiting amounts (doses) are in a range of about 0.1 mg/kg to about 100 mg/kg, and any numerical value or range or value within such ranges. Greater or lesser amounts (doses) can be administered, for example, 0.01-500 mg/kg, and any numerical value or range or value within such ranges. The dose can be adjusted according to the mass of a subject, and will generally be in a range from about 1-10 ug/kg, 10-25 ug/kg, 25-50 ug/kg, 50-100 ug/kg, 100-500 ug/kg, 500-1,000 ug/kg, 1-5 mg/kg, 5-10 mg/kg, 10-20 mg/kg, 20-50 mg/kg, 50-100 mg/kg, 100-250 mg/kg, 250-500 mg/kg, or more, two, three, four, or more times per hour, day, week, month or annually. A typical range will be from about 0.3 mg/kg to about 50 mg/kg, 0-25 mg/kg, or 1.0-10 mg/kg, or any numerical value or range or value within such ranges.

Doses can vary and depend upon whether the treatment is prophylactic or therapeutic, whether a subject has been previously exposed to the antigen/allergen, the onset, progression, severity, frequency, duration, probability of or susceptibility of the symptom, condition, pathology or complication, or vaccination or specific immunotherapy to which treatment is directed, the clinical endpoint desired, previous or simultaneous treatments, the general health, age, gender, race or immunological competency of the subject and other factors that will be appreciated by the skilled artisan. The skilled artisan will appreciate the factors that may influence the dosage and timing required to provide an amount sufficient for providing a therapeutic or prophylactic benefit.

Typically, for treatment, a protein, peptide, subsequence, portion, homologue, variant or derivative thereof, will be administered as soon as practical, typically within 1-2, 2-4, 4-12, 12-24 or 24-72 hours after a subject is exposed to or contacted with an allergen, or within 1-2, 2-4, 4-12, 12-24 or 24-48 hours after onset or development of one or more of an allergic response, allergic disorder or allergic disease, or one or more physiological conditions, disorders, illnesses, diseases, symptoms or complications caused by or associated with an antigen/allergen.

For prophylactic treatment in connection with vaccination or specific immunotherapy, proteins, peptides, subsequences, portions, homologues, variants or derivatives thereof, can be administered for a duration of 0-4 weeks, e.g., 2-3 weeks, prior to exposure to or contact by an allergen or at least within 1-2, 2-4, 4-12, 12-24, 24-48 or 48-72 hours prior to exposure to or contact by an allergen. For an acute allergic reaction, proteins, peptides, subsequences, portions, homologues, variants or derivatives thereof may be administered at any appropriate time.

The dose amount, number, frequency or duration may be proportionally increased or reduced, as indicated by the status of the subject. For example, whether the subject has an allergic response, whether the subject has been exposed to or contacted by an allergen or is merely at risk of allergen contact or exposure, whether the subject is a candidate for or will be vaccinated or provided specific immunotherapy. The dose amount, number, frequency or duration may be proportionally increased or reduced, as indicated by any adverse side effects, complications or other risk factors of the treatment or therapy.

In methods and uses of the invention, the route, dose, number and frequency of administrations, treatments, vaccinations and specific immunotherapy, and timing/intervals between treatment, vaccination and specific immunotherapy, and allergen exposure can be modified. Although rapid induction of immune responses or immunological tolerance is desired for developing protective emergency vaccines against an allergic response, allergic disorder or allergic disease, or one or more physiological conditions, disorders, illnesses, diseases, symptoms or complications caused by or associated with an allergen, in certain embodiments, a desirable treatment will elicit robust, long-lasting protection against an allergic response, allergic disorder or allergic disease, or one or more physiological conditions, disorders, illnesses, diseases, symptoms or complications caused by or associated with an allergen. Thus, in certain embodiments, invention compositions, methods and uses provide long-lasting protection against an allergic response, allergic disorder or allergic disease, or one or more physiological conditions, disorders, illnesses, diseases, symptoms or complications caused by or associated with an allergen. Specific immunotherapy strategies can provide long-lived protection against an allergic response, allergic disorder or allergic disease, or one or more physiological conditions, disorders, illnesses, diseases, symptoms or complications caused by or associated with an allergen depending on the level of induced immunological tolerance or a T cell response or activity.

TG proteins or peptides, or subsequences, portions, homologues, variants or derivatives thereof can be provided in compositions, and in turn such compositions can be used in accordance with the invention methods and uses. Such compositions, methods and uses include pharmaceutical compositions and formulations. In certain embodiments, a pharmaceutical composition includes one or more TG proteins, peptides, subsequences, portions, homologues, variants or derivatives thereof described herein (e.g., an amino acid sequence of a TG protein or peptide set forth in Table 1 (SEQ ID NOS 1-620), Table 2 (SEQ ID NOS 621-1442), Table 4 (SEQ ID NOS 621-1442) or Table 6). In particular, aspects, such compositions and formulations may be a vaccine, including but not limited to a vaccine to protect against an allergic response, allergic disorder or allergic disease, or one or more physiological conditions, disorders, illnesses, diseases, symptoms or complications caused by or associated with an allergen.

As used herein the term "pharmaceutically acceptable" and "physiologically acceptable" mean a biologically acceptable formulation, gaseous, liquid or solid, or mixture thereof, which is suitable for one or more routes of administration, in vivo delivery or contact. Such formulations include solvents (aqueous or non-aqueous), solutions (aqueous or non-aqueous), emulsions (e.g., oil-in-water or water-in-oil), suspensions, syrups, elixirs, dispersion and suspension media, coatings, isotonic and absorption promoting or delaying agents, compatible with pharmaceutical administration or in vivo contact or delivery. Aqueous and non-aqueous solvents, solutions and suspensions may include suspending agents and thickening agents. Such pharmaceutically acceptable carriers include tablets (coated or uncoated), capsules (hard or soft), microbeads, powder, granules and crystals. Supplementary active compounds (e.g., preservatives, antibacterial, antiviral and antifungal agents) can also be incorporated into the compositions.

To increase an immune response, immunological tolerance or protection against an allergic response, allergic disorder or allergic disease, or one or more physiological conditions, disorders, illnesses, diseases, symptoms or complications caused by or associated with an allergen, proteins, peptides, subsequences, portions, homologues, variants or derivatives thereof, can be coupled to another protein such as ovalbumin or keyhole limpet hemocyanin (KLH), thyroglobulin or a toxin such as tetanus or cholera toxin. Proteins, peptides, subsequences, portions, homologues, variants or derivatives thereof can also be mixed with adjuvants.

Adjuvants include, for example: oil (mineral or organic) emulsion adjuvants such as Freund's complete (CFA) and incomplete adjuvant (IFA) (WO 95/17210; WO 98/56414; WO 99/12565; WO 99/11241; and U.S. Pat. No. 5,422,109); metal and metallic salts, such as aluminum and aluminum salts, such as aluminum phosphate or aluminum hydroxide, alum (hydrated potassium aluminum sulfate); bacterially derived compounds, such as Monophosphoryl lipid A and derivatives thereof (e.g., 3 De-O-acylated monophosphoryl lipid A, aka 3D-MPL or d3-MPL, to indicate that position 3 of the reducing end glucosamine is de-O-acylated, 3D-MPL consisting of the tri and tetra acyl congeners), and enterobacterial lipopolysaccharides (LPS); plant derived saponins and derivatives thereof, for example Quil A (isolated from the Quilaja *Saponaria* Molina tree, see, e.g., "Saponin adjuvants", Archiv. fur die gesamte Virusforschung, Vol. 44, Springer Verlag, Berlin, p 243-254; U.S. Pat. No. 5,057, 540), and fragments of Quil A which retain adjuvant activity without associated toxicity, for example QS7 and QS21 (also known as QA7 and QA21), as described in WO96/33739, for example; surfactants such as, soya lecithin and oleic acid; sorbitan esters such as sorbitan trioleate; and polyvinylpyrrolidone; oligonucleotides such as CpG (WO 96/02555, and WO 98/16247), polyriboA and polyriboU; block copolymers; and immunostimulatory cytokines such as GM-CSF and IL-1, and Muramyl tripeptide (MTP). Additional examples of adjuvants are described, for example, in "Vaccine Design—the subunit and adjuvant approach" (Edited by Powell, M. F. and Newman, M. J.; 1995, Pharmaceutical Biotechnology (Plenum Press, New York and London, ISBN 0-306-44867-X) entitled "Compendium of vaccine adjuvants and excipients" by Powell, M. F. and Newman M.

Cosolvents may be added to a protein, peptide, subsequence, portion, homologue, variant or derivative thereof, composition or formulation. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters.

Supplementary compounds (e.g., preservatives, antioxidants, antimicrobial agents including biocides and biostats such as antibacterial, antiviral and antifungal agents) can also be incorporated into the compositions. Pharmaceutical compositions may therefore include preservatives, anti-oxidants and antimicrobial agents.

Preservatives can be used to inhibit microbial growth or increase stability of ingredients thereby prolonging the shelf life of the pharmaceutical formulation. Suitable preservatives are known in the art and include, for example, EDTA, EGTA, benzalkonium chloride or benzoic acid or benzoates, such as sodium benzoate. Antioxidants include, for example, ascorbic acid, vitamin A, vitamin E, tocopherols, and similar vitamins or provitamins.

An antimicrobial agent or compound directly or indirectly inhibits, reduces, delays, halts, eliminates, arrests, suppresses or prevents contamination by or growth, infectivity, replication, proliferation, reproduction, of a pathogenic or non-pathogenic microbial organism. Classes of antimicrobials include antibacterial, antiviral, antifungal and antiparasitics. Antimicrobials include agents and compounds that kill or destroy (-cidal) or inhibit (-static) contamination by or growth, infectivity, replication, proliferation, reproduction of the microbial organism.

Exemplary antibacterials (antibiotics) include penicillins (e.g., penicillin G, ampicillin, methicillin, oxacillin, and amoxicillin), cephalosporins (e.g., cefadroxil, ceforanid, cefotaxime, and ceftriaxone), tetracyclines (e.g., doxycycline, chlortetracycline, minocycline, and tetracycline), aminoglycosides (e.g., amikacin, gentamycin, kanamycin, neomycin, streptomycin, netilmicin, paromomycin and tobramycin), macrolides (e.g., azithromycin, clarithromycin, and erythromycin), fluoroquinolones (e.g., ciprofloxacin, lomefloxacin, and norfloxacin), and other antibiotics including chloramphenicol, clindamycin, cycloserine, isoniazid, rifampin, vancomycin, aztreonam, clavulanic acid, imipenem, polymyxin, bacitracin, amphotericin and nystatin.

Particular non-limiting classes of anti-virals include reverse transcriptase inhibitors; protease inhibitors; thymidine kinase inhibitors; sugar or glycoprotein synthesis inhibitors; structural protein synthesis inhibitors; nucleoside analogues; and viral maturation inhibitors. Specific non-limiting examples of anti-virals include nevirapine, delavirdine, efavirenz, saquinavir, ritonavir, indinavir, nelfinavir, amprenavir, zidovudine (AZT), stavudine (d4T), lamivudine (3TC), didanosine (DDI), zalcitabine (ddC), abacavir, acyclovir, penciclovir, ribavirin, valacyclovir, ganciclovir, 1,-D-ribofuranosyl-1,2,4-triazole-3 carboxamide, 9->2-hydroxyethoxy methylguanine, adamantanamine, 5-iodo-2'-deoxyuridine, trifluorothymidine, interferon and adenine arabinoside.

Pharmaceutical formulations and delivery systems appropriate for the compositions, methods and uses of the invention are known in the art (see, e.g., *Remington: The Science and Practice of Pharmacy* (2003) 20$^{th}$ ed., Mack Publishing Co., Easton, Pa.; *Remington's Pharmaceutical Sciences* (1990) 18$^{th}$ ed., Mack Publishing Co., Easton, Pa.; *The Merck Index* (1996) 12$^{th}$ ed., Merck Publishing Group, Whitehouse, N.J.; *Pharmaceutical Principles of Solid Dosage Forms* (1993), Technonic Publishing Co., Inc., Lancaster, Pa.; Ansel ad Soklosa, *Pharmaceutical Calculations* (2001) 11$^{th}$ ed., Lippincott Williams & Wilkins, Baltimore, Md.; and Poznansky et al., *Drug Delivery Systems* (1980), R. L. Juliano, ed., Oxford, N.Y., pp. 253-315).

Pharmaceutical compositions can be formulated to be compatible with a particular route of administration. Thus, pharmaceutical compositions include carriers, diluents, or excipients suitable for administration by various routes. Exemplary routes of administration for contact or in vivo delivery which a composition can optionally be formulated include inhalation, respiration, intranasal, intubation, intrapulmonary instillation, oral, buccal, intrapulmonary, intradermal, topical, dermal, parenteral, sublingual, subcutaneous, intravascular, intrathecal, intraarticular, intracavity, transdermal, iontophoretic, intraocular, ophthalmic, optical, intravenous (i.v.), intramuscular, intraglandular, intraorgan, or intralymphatic.

Formulations suitable for parenteral administration include aqueous and non-aqueous solutions, suspensions or emulsions of the active compound, which preparations are typically sterile and can be isotonic with the blood of the intended recipient. Non-limiting illustrative examples include water, saline, dextrose, fructose, ethanol, animal, vegetable or synthetic oils.

Methods and uses of the invention may be practiced by any mode of administration or delivery, or by any route, systemic, regional and local administration or delivery. Exemplary administration and delivery routes include intravenous (i.v.), intraperitoneal (i.p.), intrarterial, intramuscular, parenteral, subcutaneous, intra-pleural, topical, dermal, intradermal, transdermal, transmucosal, intra-cranial, intraspinal, rectal, oral (alimentary), mucosal, inhalation, respiration, intranasal, intubation, intrapulmonary, intrapulmonary instillation, buccal, sublingual, intravascular, intrathecal, intracavity, iontophoretic, intraocular, ophthalmic, optical, intraglandular, intraorgan, or intralymphatic.

For oral administration, a composition can take the form of, for example, tablets or capsules prepared by conventional means with pharmaceutically acceptable excipients such as binding agents (for example, pregelatinised maize starch, polyvinylpyrrolidone or hydroxypropyl methylcellulose); fillers (for example, lactose, microcrystalline cellulose or calcium hydrogen phosphate); lubricants (for example, magnesium stearate, talc or silica); disintegrants (for example, potato starch or sodium starch glycolate); or wetting agents (for example, sodium lauryl sulphate). The tablets can be coated by methods known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (for example, sorbitol syrup, cellulose derivatives or hydrogenated edible fats); emulsifying agents (for example, lecithin or acacia); non-aqueous vehicles (for example, almond oil, oily esters, ethyl alcohol or fractionated vegetable oils); and preservatives (for example, methyl or propyl-p-hydroxybenzoates or sorbic acid). The preparations can also contain buffer salts, flavoring, coloring, and sweetening agents as appropriate.

For administration by inhalation, a composition can be delivered in the form of an aerosol spray presentation from pressurized packs or a nebulizer, with the use of a suitable propellant, for example, dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges for use in an inhaler or insufflator can be formulated containing a powder mix of the compound and a suitable powder base such as lactose or starch.

Invention TG proteins and peptides, e.g., a protein or peptide set forth in Table 1 (SEQ ID NOS 1-620), Table 2 (SEQ ID NOS 621-1442), Table 4 (SEQ ID NOS 621-1442) or Table 6), subsequences, portions, homologues, variants or derivatives thereof optionally along with any adjunct agent, compound, drug, composition, whether active or inactive, etc., can be packaged in unit dosage form (capsules, tablets, troches, cachets, lozenges) for ease of administration and uniformity of dosage. A "unit dosage form" as used herein refers to physically discrete units suited as unitary dosages for the subject to be treated; each unit containing a predetermined quantity of active ingredient optionally in association with a pharmaceutical carrier (excipient, diluent, vehicle or filling agent) which, when administered in one or more doses, is calculated to produce a desired effect (e.g., prophylactic or therapeutic effect). Unit dosage forms also include, for example, ampules and vials, which may include a composition in a freeze-dried or lyophilized state; a sterile liquid carrier, for example, can be added prior to administration or delivery in vivo. Unit dosage forms additionally include, for example, ampules and vials with liquid compositions disposed therein. Individual unit dosage forms can be included in multi-dose kits or containers. Pharmaceutical formulations can be packaged in single or multiple unit dosage form for ease of administration and uniformity of dosage.

The invention also provides methods of diagnosing and detecting an allergic response or allergy in a subject. The methods can be performed in solution, in solid phase, in silica, in vitro, in a cell, and in vivo. In one embodiment, a method includes contacting a cell (e.g., T cell) from the subject with a TG protein, peptide, subsequence, portion, homologue, variant or derivative thereof, as described herein (e.g., of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6); and determining if the protein or peptide modulates an immune response or activity of the contacted cell (e.g., T cell). A determination that the TG protein or peptide modulates an immune response or immune activity of the contacted cell indicates that the subject has an allergic response or an allergy, in particular, an allergy to the protein, peptide, subsequence, portion, homologue, variant or derivative thereof (e.g., of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6). In a particular aspect, the immune activity determined is Th2 cell reactivity. In another particular aspect, immune response or activity is determined by assaying for a cutaneous immunological hypersensitive reaction.

The terms "determining," "assaying" and "measuring" and grammatical variations thereof are used interchangeably herein and refer to either qualitative or quantitative determinations, or both qualitative and quantitative determinations, that involve manipulation or processing. When the terms are used in reference to measurement or detection, any means of assessing the relative amount, including the various methods set forth herein and known in the art, performed by the hand of man, is contemplated.

The invention provides kits including TG protein, peptide, subsequence, portion, homologue, variant or derivative thereof (e.g., of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6), combination compositions and pharmaceutical formulations thereof, packaged into suitable packaging material. Kits can be used in various in vitro, ex vivo and in vivo methods and uses, for example a treatment method or use as disclosed herein.

A kit typically includes a label or packaging insert including a description of the components or instructions for use in vitro, in vivo, or ex vivo, of the components therein. A kit can contain a collection of such components, e.g., a TG protein, peptide, subsequence, portion, homologue, variant or derivative thereof (e.g., of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6), alone, or in combination with another therapeutically useful composition (e.g., an immune modulatory drug).

The term "packaging material" refers to a physical structure housing the components of the kit. The packaging material can maintain the components sterilely, and can be made of material commonly used for such purposes (e.g., paper, corrugated fiber, glass, plastic, foil, ampules, vials, tubes, etc.).

Kits of the invention can include labels or inserts. Labels or inserts include "printed matter," e.g., paper or cardboard, or separate or affixed to a component, a kit or packing material (e.g., a box), or attached to an ampule, tube or vial containing a kit component. Labels or inserts can additionally include a computer readable medium, such as a disk (e.g., hard disk), optical disk such as CD- or DVD-ROM/RAM, DVD, MP3, magnetic tape, or an electrical storage media such as RAM and ROM or hybrids of these such as magnetic/optical storage media, FLASH media or memory type cards.

Labels or inserts can include identifying information of one or more components therein, dose amounts, clinical pharmacology of the active ingredient(s) including mechanism of action, pharmacokinetics and pharmacodynamics. Labels or inserts can include information identifying manufacturer information, lot numbers, manufacturer location and date.

Labels or inserts can include information on a condition, disorder, disease or symptom for which a kit component may be used. Labels or inserts can include instructions for the clinician or for a subject for using one or more of the kit components in a method, use, treatment protocol or therapeutic regimen. Instructions can include dosage amounts, frequency or duration, and instructions for practicing any of the methods and uses, treatment protocols or therapeutic regimes set forth herein. Exemplary instructions include, instructions for modulating an immune response or activity of a cell against an allergen; modulating an immune response against an allergen in a subject; desensitizing, or inducing, eliciting, increasing or improving immunological tolerance to a protein or peptide allergen; reducing risk or providing a subject protection against an allergic reaction, allergic response, allergic disorder or allergic disease; treating an allergic reaction, allergic response, allergic disorder or allergic disease; or detecting an allergic response or diagnosing an allergy in a subject.

Labels or inserts can include information on any benefit that a component may provide, such as a prophylactic or therapeutic benefit. Labels or inserts can include information on potential adverse side effects, such as warnings to the subject or clinician regarding situations where it would not be appropriate to use a particular composition. Adverse side effects could also occur when the subject has, will be or is currently taking one or more other medications that may be incompatible with the composition, or the subject has, will be or is currently undergoing another treatment protocol or therapeutic regimen which would be incompatible with the composition and, therefore, instructions could include information regarding such incompatibilities.

Invention kits can additionally include other components. Each component of the kit can be enclosed within an individual container and all of the various containers can be within a single package. Invention kits can be designed for cold storage. Invention kits can further be designed to contain to the protein, peptide, subsequence, portion, homologue, variant or derivative thereof (e.g., of an amino acid sequence of a TG protein or peptide set forth in Table 1 (SEQ ID NOS 1-620), Table 2 (SEQ ID NOS 621-1442), Table 4 (SEQ ID NOS 621-1442) or Table 6), or combination compositions or pharmaceutical compositions.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described herein.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the invention is not entitled to antedate such publication by virtue of prior invention.

As used in this specification and the appended claims, the use of an indefinite article or the singular forms "a," "an" and "the" include plural reference unless the context clearly dictates otherwise. In addition, it should be understood that the individual peptides, proteins, antigens, allergens (referred to collectively as compositions), or groups of compositions, modeled or derived from the various components or combinations of the compositions, and substituents described herein, are disclosed by the application to the same extent as if each composition or group of compositions was set forth individually. Thus, selection of particular peptides, proteins, antigens, allergens, etc. is clearly within the scope of the invention.

As used in this specification and the appended claims, the terms "comprise", "comprising", "comprises" and other forms of these terms are intended in the non-limiting inclusive sense, that is, to include particular recited elements or components without excluding any other element or component. Unless defined otherwise all technical and scientific terms used herein have the same meaning as commonly understood to one of ordinary skill in the art to which this invention belongs. As used herein, "about" means+ or −5%. The use of the alternative (e.g., "or") should be understood to mean one, both, or any combination thereof of the alternatives, i.e., "or" can also refer to "and."

As used in this specification and the appended claims, any concentration range, percentage range, ratio range or other integer range is to be understood to include the value of any integer within the recited range and, when appropriate, fractions thereof (such as one tenth and one hundredth of an integer), unless otherwise indicated. For example, although numerical values are often presented in a range format throughout this document, a range format is merely for convenience and brevity and should not be construed as an inflexible limitation on the scope of the invention. Accordingly, the use of a range expressly includes all possible subranges, all individual numerical values within that range, and all numerical values or numerical ranges including integers within such ranges and fractions of the values or the integers within ranges unless the context clearly indicates otherwise. This construction applies regardless of the breadth of the range and in all contexts throughout this patent document. Thus, to illustrate, reference to a range of 90-100% includes 91-99%, 92-98%, 93-95%, 91-98%, 91-97%, 91-96%, 91-95%, 91-94%, 91-93%, and so forth. Reference to a range of 90-100%, includes 91%, 92%, 93%, 94%, 95%, 95%, 97%, etc., as well as 91.1%, 91.2%, 91.3%, 91.4%, 91.5%, etc., 92.1%, 92.2%, 92.3%, 92.4%, 92.5%, etc., and so forth. Reference to a range of 5-10, 10-20, 20-30, 30-40, 40-50, 50-75, 75-100, 100-150, and 150-175, includes ranges such as 5-20, 5-30, 5-40, 5-50, 5-75, 5-100, 5-150, 5-171, and 10-30, 10-40, 10-50, 10-75, 10-100, 10-150, 10-175, and 20-40, 20-50, 20-75, 20-100, 20-150, 20-175, and so forth. Further, for example, reference to a series of ranges of 2-72 hours, 2-48 hours, 4-24 hours, 4-18 hours and 6-12 hours, includes ranges of 2-6 hours, 2, 12 hours, 2-18 hours, 2-24 hours, etc., and 4-27 hours, 4-48 hours, 4-6 hours, etc.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims. The invention is further exemplified by way of the following non-limited examples.

EXAMPLES

Example 1

This example includes a description of materials and methods.

Donor Population.

Each donor was recruited following Institutional Review Board approval (Federal Wide Assurance number 00000032) and informed consent and assigned a study identification number. Donors were tested for allergen reactivity by skin prick tests to extracts from 32 common allergens. TG allergic donors were identified as having a skin reaction with a wheal of 5 mm in diameter to TG and a clinical history consistent with seasonal grass pollen allergy. Donors that had received specific immunotherapy were excluded. Non-allergic donors were identified as having negative skin prick tests to all allergens and no clinical history of allergy.

Identification of Novel TG Pollen Proteins.

Novel TG pollen proteins were identified as follows:

Assembly of TG Pollen Transcriptome.

Novel Timothy grass (TG) pollen proteins that are potential T cell antigens were identified by a combination of 2D gel/immunoblot analysis and cDNA sequence analysis of soluble pollen extract. Total RNA of TG pollen was isolated as previously described (Allergon AB, Ängelholm, Sweden) (31). In brief, 1 mg ground pollen was homogenized in 20 ml 4.2 M guanidine hiocyanate, 50 mM of BES pH 7.2, 4 mM EDTA followed by centrifugation at 15000 g for 15 min. Total RNA was prepared from the supernatant using the TRIzol LS Reagent (Invitrogen, Carlsbad, Calif., USA) according to the manufacturer's instructions. The RNA was then analyzed by high-throughput sequencing on an Illumina Genome Analyzer. First, double stranded cDNA was constructed from total RNA using the Illumina TotalPrep RNA Amplification kit (Ambion). The cDNA was then converted into fragments of approximately 200 bp using NEBNext® dsDNA Fragmentase™ (New England Biolabs). The ends were repaired, dA tails were added to the fragmented DNA using NEBNext® DNA Sample Preparation kit, and adaptors were added. Sequencing was performed on an Illumina Genome Analyzer IIx (GAIN). Briefly, adaptor ligated cDNA was loaded into an Illumina flow cell. DNA was then bridge-amplified within the flowcell to generate millions of DNA clusters, using specific reagents and enzymes (Illumina Paired-End Cluster Generation Kit). The flow cell was then loaded onto the GAIN equipped with a paired-end module, and 72 sequencing cycles were performed to generate sequence in both directions using Illumina Sequencing Kit v4. Replicate samples were run in 7 of the 8 lanes on the flow cell, producing over 280 million raw sequence reads of 72 bp in length. Reads went through several preprocessing steps using the FastX toolkit (33) before they were assembled into contigs: 1) the 3' terminal base was removed; 2) low-complexity reads were removed; 3) portions of reads downstream of a low quality score were removed; 4) portions of reads corresponding to adapter sequencers were removed. The remaining reads were assembled into contigs using Velvet version 1.0.15 (32). Due to the excessive memory requirements inherent to de novo sequence assembly, the reads for each lane were considered separately and were each run with five different values for the word size parameter (k=21, 23, 25, 27, 29). The present inventors and others (33) have observed that different sets of contigs are obtained for each value for k. The contigs were further merged with Oases version 0.18.1 (D. R. Zerbino, European Bioinformatics Institute) into 1,764,158 putative transcripts. After redundancy reduction, 1,016,285 transcripts remained (including isoforms and other variants) with an average length of 245 bp and a maximum length of 6,884 bp.

2D DIGE (Difference Gel Electrophoresis) analysis. The complete 2D DIGE analysis was performed by Applied Biomics (Hayward, Calif., US). Briefly, TG extract was run on two 2D gels (3-10 pH range, 12% SDS-acrylamide gel), one was Coomassie blue stained, the other was blotted onto a nitrocellulose membrane. The membrane was then incubated with 5% dried milk in PBS/0.05% Tween to block non-specific binding and subsequently probed with a serum pool from 8 TG-allergic individuals at a dilution of 1:250. IgE and IgG binding was detected using goat anti-human IgE and rabbit anti-human IgG (Sigma-Aldrich, St. Louis, Mo.) and visualized using Cy2-conjugated donkey anti-goat IgG and Cy5-conjugated donkey anti-mouse IgG antibodies (Biotium, Hayward, Calif.).

Pollen Protein Identification by Mass Spectrometry.

Mass spectral protein identification was performed by Applied Biomics (Hayward, Calif., US). Briefly, spots of interest were selected from the 2D blot and the corresponding spots were identified on the stained SDS gel and cut out, washed several times to remove staining dye and other inhibitory chemicals. The spots were then dried to absorb maximum digestion buffer. Dried 2D gel spots were rehydrated in digestion buffer containing trypsin. Proteins were digested in-gel at 37° C. and then extracted from the gel with TFA extraction buffer. Subsequently the peptides were desalted using C-18 Zip-tips (Millipore) and mixed with CHCA matrix (alpha-cyano-4-hydroxycinnamic acid) and spotted into wells of a MALDI plate. Mass spectra of the peptides in each sample were obtained using an Applied Biosystems Proteomics Analyzer. The spectra were compared to the amino acid sequences encoded by putative ORFs from the de novo assembled TG pollen transcripts. All ORFs encoding for 15 amino acid residues or longer that had a >95% confidence hit as evaluated by the Mascot software package (Matrix science) were considered hits (Table 1). The amino acid sequences encoded by these ORFs were clustered using a custom script at a sequence similarity threshold of 90% to group together highly similar protein sequences. These sequences are encoded by different transcripts from the current assembly, which could arise from splice variants, allelic variation between cells of TG pollen, and from gene families with multiple members. Amino acid sequences that form one cluster are assigned one putative protein ID (Table 1).

Assembly of a Peptide Set Predicted to Promiscuously Bind HLA Class II Molecules.

For each 15-mer peptide encoded in the ORFs in Table 2, the binding affinity to a panel of 25 HLA class II molecules was predicted (Table 3) using a consensus prediction approach (21, 22). Peptides with predicted binding scores in the top 20% for a given allele were considered potential binders. Peptides predicted to bind 13 or more HLA molecules at this threshold were considered promiscuous binders, and selected for synthesis (after eliminating peptides overlapping by more than 9 contiguous residues). If less than 5 peptides from a given protein met this threshold, the top 5 peptides were chosen, and up to 4 peptides in proteins where length was prohibitive. In total, this resulted in the selection of 822 peptides from a total of 21,506 distinct 15-mers encoded in 620 ORFs (Table 2). As a control, a set of 105 peptides was derived from the known TG allergens using the same prediction approach. The selected peptides were purchased from A and A (San Diego, Calif.) as crude material on a small (1 mg) scale. Peptides that tested positive and were included in the dominant epitope pools were purchased as purified material (>95% pure) on a 5-10 mg scale.

PBMC Isolation and In Vitro Expansion of TG Extract-Specific T Cells.

PBMCs were isolated by density gradient centrifugation from one unit of blood (~450 ml) and cryo-preserved as described previously (12). For in vitro expansions, PBMCs were thawed and cultured in RPMI 1640 (Ω Scientific, Tarzana, Calif.) supplemented with 5% human AB serum (Cellgro, Herndon, Va.) at a density of 2×106 cells/ml in 24-well plates (BD Biosciences, San Jose, Calif.) and stimulated with TG pollen extract (50 mg/ml) (Greer, Lenoir, N.C.). Cells were kept at 37° C., 5% CO2 and additional IL-2 and IL-7 (10 U/ml, eBioscience, San Diego, Calif.) was added every 3 d after initial antigenic stimulation. On day 14, cells were harvested and screened for reactivity against TG-specific peptide pools (16-25 peptides/pool, averaging 20 peptides/pool). On day 17, peptides from positive pools were tested individually to identify the reactive epitopes.

ELISPOT Assays.

The production of IL-5 from cultured PBMCs in response to antigen stimulation was measured by ELISPOT as described previously (12). Briefly, 1×105 cells/well were incubated with peptide, peptide pool or TG extract (10 µg/ml, 5 µg/ml and 50 µg/ml, respectively). After 24 h, cells were removed and plates were incubated with 2 µg/ml biotinylated anti-human IL-5 Ab (Mabtech) at 37° C. After 2 h, plates were washed and avidin-peroxidase-complex was added (Vector Laboratories, Burlingame, Calif.) for 1 h at RT. Peroxidase-conjugated spots were developed with 3-amino-9-ethylcarvazole solution (Sigma-Aldrich, St. Louis, Mo.). Criteria for peptide pool positivity were 100 SFCs/106 PBMCs, p 0.05, and a stimulation index (SI) 2. Criteria for individual peptides were the same except a minimum of 20 SFCs was counted as positive.

FACS Sorting of T Cell Subpopulations.

PBMCs were thawed, washed and counted. CD4+ T cells were isolated using a CD4+ T cell isolation Kit II (Miltenyi Biotec, Auburn, Calif.) according to manufacturer's instructions and subsequently stained with antibodies to sort desired T cell subpopulations. Memory and naïve T cell populations were sorted from CD4+ cells stained with CD45RA-FITC and CCR7-BL421. The naïve population was sorted as CD45RA+CCR7+ and the memory population was sorted as CD45RA− CCR7−/+. CD45RA+CCR7− cells were not collected. Subsequently these subpopulations were put into culture with irradiated PBMC and stimulated with TG pollen extract and cultured for 14 days with IL-2 and IL-7 added every 3 days. IL-5 production in response to stimuli was assessed by ELISPOT. For Th1 and Th2 subpopulations, cells were sorted from CD4+ cells stained with CCR4-PECy7, CCR6-PE and CXCR3-APC. Th2 cells were sorted as CCR4+CCR6−CXCR3− T cells and Th1 cells were sorted as CCR4-CCR6+CXCR3+ T cells. Sorted cells were plated into ELISPOT plates with stimulus and CD4 depleted, irradiated PBMC as APC. IL-5 production was assessed after 24 h incubation.

Example 2

This example includes a description of studies showing that a significant fraction of TG reactive T cells in allergic donors do not target the major IgE reactive allergens.

In a previous study (12), the T cell epitopes in the ten known major IgE reactive allergens present in TG pollen were determined. Using 15-mer peptides overlapping by 10 residues that spanned the entire protein sequence of each of these allergens, 20 dominant epitopic regions accounting for the majority of T cell responses were identified. However, despite this comprehensive panel of peptides and the sensitivity of the T cell assays used, this study did not identify any IL-5 producing T cells responding to these ten allergens in 33% of the allergic donors tested despite strong responses (≥100 Spot Forming Cells (SFC)) to the whole TG extract (FIG. 1). These data suggested that a significant portion of the T cell response to TG was directed against antigens other than the known major IgE reactive allergens.

Example 3

This example includes a description of studies showing identification of novel TG pollen proteins through a combined transcriptomics and proteomics analysis.

As few proteins apart from IgE reactive allergens have been identified in TG (or any other allergenic grasses), the identification of all proteins with significant expression in TG pollen were pursued so that a more comprehensive analysis of T cell responses to TG could be performed. mRNA of TG pollen was isolated and analyzed by high-throughput sequencing on an Illumina Genome Analyzer. A total of 1,016,285 unique, putative transcripts (including allelic variants and isoforms) were identified. Of the ten known TG allergen proteins considered in the previous study (Phl p 1, 2, 3, 4, 5, 6, 7, 11, 12 and 13), all but one (Phl p 6) were identified in the transcriptome analysis with large fragments or entire sequences matching at >90% identity. Interestingly, one transcript matched the published Phl p 6 sequence with very high significance (Blast E-value of 4E-16) but much lower sequence identity (61%). This demonstrated that the transcripts identified from TG pollen mRNA recovered the vast majority of known allergens, but the approach herein also identified putative new variants of known allergens.

Figure 2:
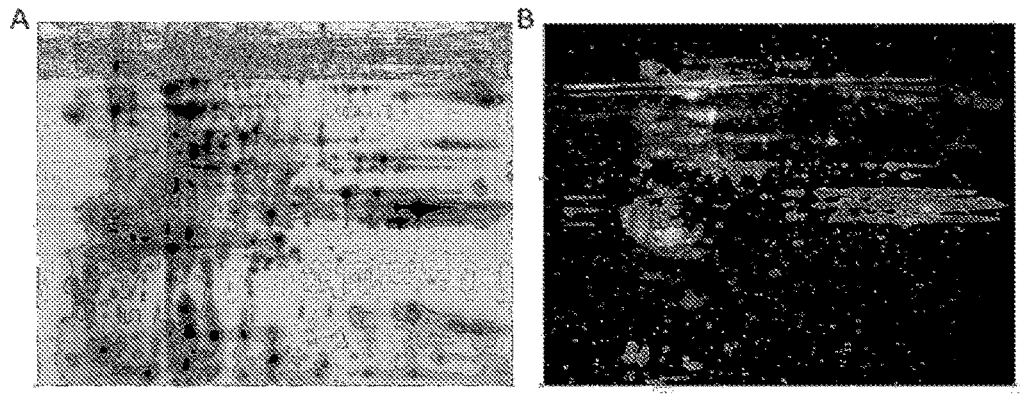
FIGS. 2A-2B show a 2D gel electrophoresis and immunoblot analysis of TG extract using pooled sera from allergic donors. TG pollen extract was run on a 2D gel and stained with Coomassie brilliant blue (A). A second gel run in parallel was blotted and probed with a serum pool from 8 TG-allergic donors to identify proteins reactive with human IgE and IgG. Anti IgE-red, anti IgG-green, dual reactivity-yellow (B).

Next, a proteomics approach was utilized to determine which of the newly identified transcripts encoded proteins detectable in TG pollen. For this purpose, TG pollen extract was separated by 2D gel electrophoresis and either stained with Coomassie blue or immuno-blotted using a pool of sera from 8 TG allergic donors (FIG. 2) to detect proteins reactive with IgE and/or IgG antibodies. Spots were cut out from unstained gels, trypsin digested, and analyzed by peptide fingerprint mass mapping (using MS data) and peptide fragmentation mapping (using MS/MS data) to obtain amino acid sequences. Of 131 spots picked from the 2D gels, 119 could be assigned with high confidence to one or more open reading frames (ORFs) from the transcript sequences. After clustering ORFs with >90% sequence identity, it was found that the 119 identifiable spots corresponded to 89 non-redundant protein sequences including 6 of the known TG allergens. This left 83 distinct protein sequences corresponding to previously unidentified proteins identified by spots on the gel. To these was added another 10 proteins not identified in any spots cut out of the gel, but rather in a mass spec analysis of the whole TG extract. In total, this resulted in a set of 93 novel proteins from TG pollen that was further analyzed for T cell reactivity (Table 1).

To determine if any of the proteins identified were derived from contaminants (such as bacteria) possibly present in the TG pollen extract, the amino acid sequences were ran through NCBI BLAST. Two proteins (#27 and #38) had high homology to previously identified TG proteins that are not considered allergens. Of the remaining proteins, #76, had highly homologous (BLAST E value<10-10) matches in the rice genome (the closest to TG of all fully sequenced genomes available). Of the remaining proteins, none had similarly high homology to any publicly available sequence. Overall, based on similarity to known protein sequences, it was unlikely that the sets of protein sequences contained non-plant contaminants, indicating that the sequences were from bona fide TG proteins.

Example 4

This example includes a description of studies showing that T cells respond vigorously to epitopes from novel TG pollen proteins.

The 93 novel protein sequences were scanned for peptides predicted to bind to multiple HLA class II molecules. For each protein, all overlapping 15-mer peptides were analyzed and their binding affinity predicted to a panel of 25 HLA DR, DP and DQ molecules (Table 3) using a consensus approach of multiple machine learning methods (21,22). Non-overlapping peptides that were predicted to promiscuously bind multiple HLA class II molecules were selected from each protein. In total, this resulted in the selection of 822 peptides from a total of 21,506 distinct 15-mers (Table 2).

Figure 3:
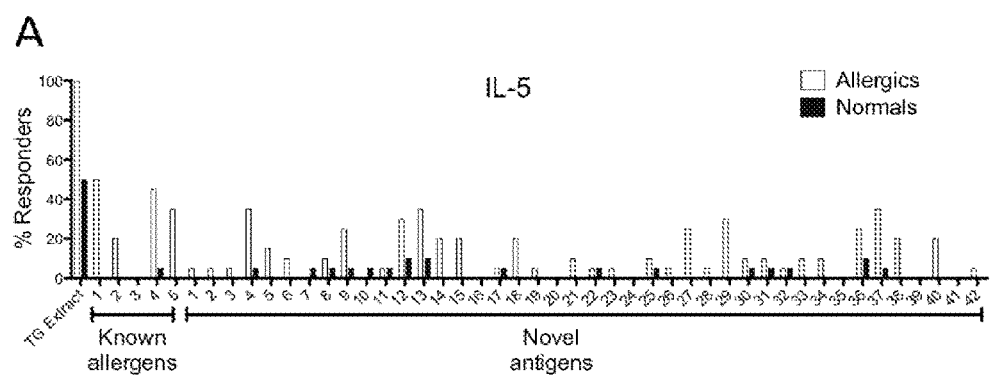
FIGS. 3A-3B show that a majority of TG specific T cells target novel antigens. A) Bar chart indicating the IL-5 response rate of PBMCs from allergic and non-allergic donors to peptide pools from known and novel antigens. Open bars indicate response rates from allergic donors, solid bars indicate responses from normal donors (n=20 per donor group). B) Bar chart showing the total number of IL-5 producing T cells targeting novel antigens (light grey) vs. known allergens (dark grey) in normal and allergic patients.
Figure 3:
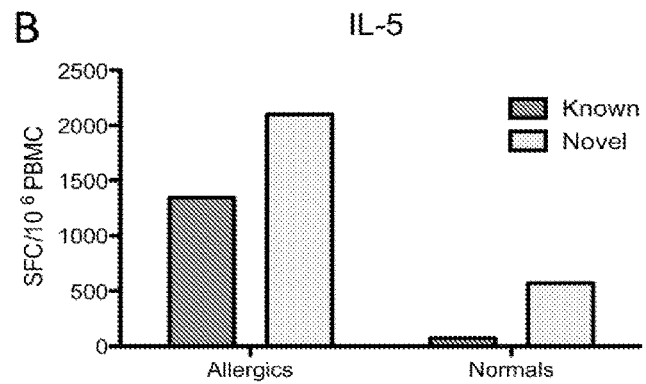
Figure 7:
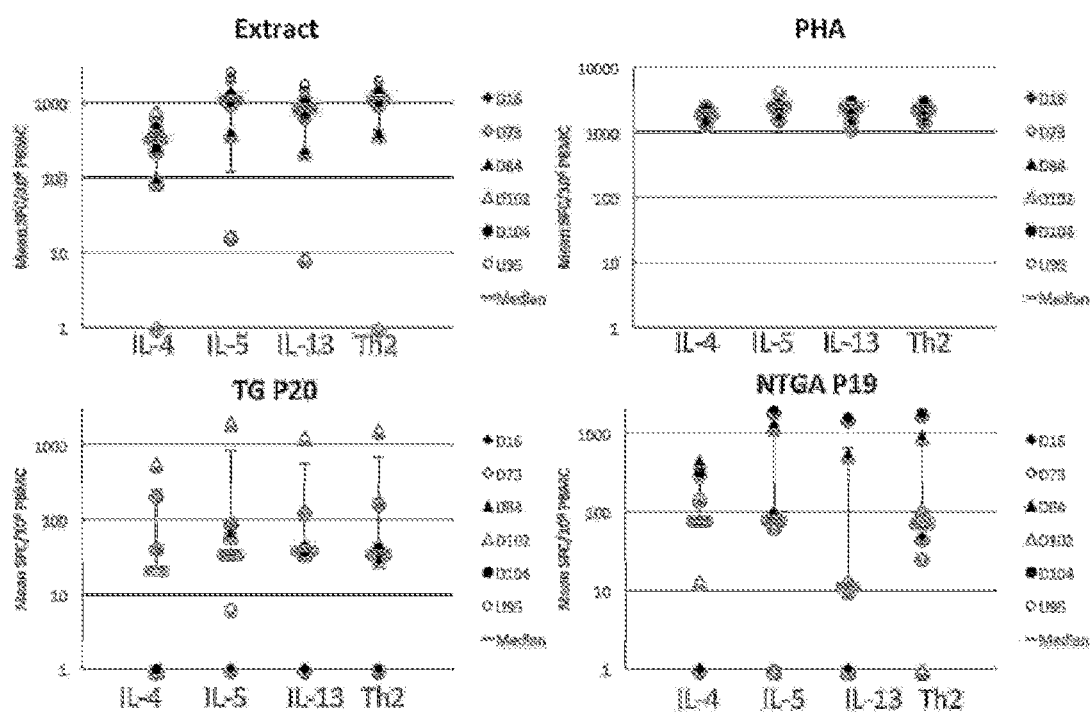
FIG. 7 shows production of IL-4, IL-5, IL-13 and all Th2 cytokines (IL-4, 5 and 13 combined) in response to TG extract, PHA, TG P20 and NTGA P19. TG stimulated cells were cultured in vitro with IL-2 for 14 days. Cells were re-stimulated with TG extract, the dominant known and novel TG peptide pools (TG P20 and NTGA P19) and PHA. Th2 cytokine production was measured by ELISPOT to determine the best read-out system.

The 822 peptides were assembled into 42 pools of about 20 peptides each, which were analyzed for recognition by PBMCs from 20 TG allergic and 20 normal donors (Table 4). IL-5 ELISPOT assays were used to measure T cell reactivity because Th2 responses are important in allergy pathogenesis. In the studies herein, IL-5 is a more sensitive read-out in ELISPOT assays compared to other Th2 cytokines, namely IL-4 and IL-13 (FIG. 7) (15). In addition to peptide pools from novel allergens, 5 peptide pools from the ten known TG allergens assembled using the same prediction strategy were analyzed. Of the novel peptide pools 13/42 pools stimulated IL-5 production in PBMCs in over 20% of allergic donors. For the known allergen pools, 4/5 pools were recognized by over 20% of allergic donors. In contrast, none of the peptide pools elicited an IL-5 response in more than 10% of the non-allergic donors (FIG. 3a).

When comparing the combined magnitude of responses directed against the known allergens vs. the Novel Timothy Grass Antigens (NTGA), it was evident that a very significant fraction of the T cell response to TG targeted the novel antigens. In fact, 61% of responding T cells (2,101 SFC, FIG. 3b) recognized novel peptides while the response directed against the control panel of peptides from major known allergens only accounted for 39% of the T cell responses (1,345 SFC, FIG. 3b). In the non-allergic population, the IL-5 responses were much weaker. However, the difference in response magnitude between the known allergens and novel antigens was even more pronounced, with 88.4% of the response targeting the novel antigens (574 SFC) and 11.6% targeting the known allergens (75 SFC). Overall, these data showed that a majority of Th2 cell responses against TG extract were directed against antigens other than the known IgE-reactive allergens.

Example 5

This example includes a description of studies showing identification of T cell reactive antigens and correlation with antibody reactivity.

Figure 4:
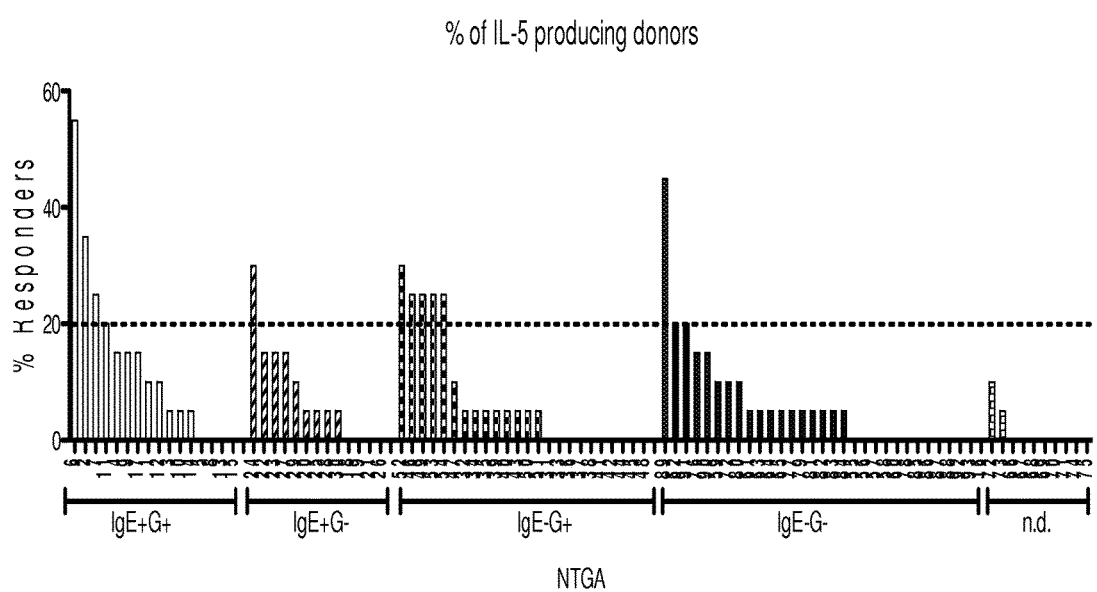
FIG. 4 shows percentage recognition of novel Timothy grass antigens (NTGA) by TG allergic donors. Bar chart showing percentage of donors producing IL-5 in response to novel Timothy grass antigens (NTGA)—derived peptide stimulation. NTGAs are categorized according to antibody reactivity as indicated on the X-axis. The dashed line indicates the minimum threshold of ≥20% recognition to be considered an allergen.
Figure 8:
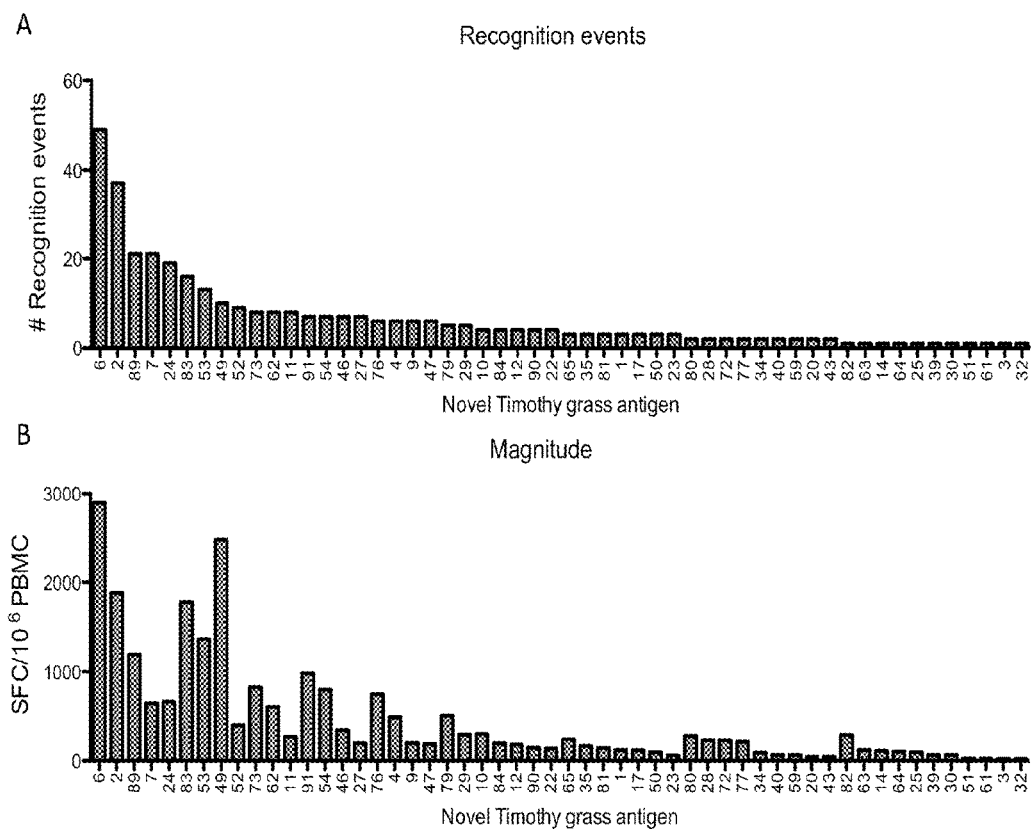
FIGS. 8A-8B show deconvolution of positive peptide pools to identify T-cell reactive antigens and epitopes. IL-5 production from PBMC of allergic individuals in response to single peptides was measured. A) Number of recognition events (defined as one peptide recognized by at least one patient with a magnitude of ≥20 SFC) per antigen tested. B) Sum of the magnitudes of IL-5 responses against peptides from each positive antigen.

Next, the positive peptide pools were deconvoluted to determine which individual peptides elicited the responses. IL-5 production was detected in at least one allergic donor for peptides from 54 of the 93 proteins analyzed with a total magnitude of 23,860 SFC (FIG. 8). To exclude spurious responses, T cell antigens for this study are defined as those proteins recognized in 20% or more of allergic donors, which is an established response threshold to define allergenic proteins when using skin test reactivity testing (23,24). Based on this cutoff, a total of thirteen novel T cell antigens were identified. Four of these T cell antigens were proteins targeted by both IgE and IgG, one protein was targeted by IgE only, five proteins were targeted by IgG only, and three proteins were not targeted by antibodies of either Ig class (FIG. 4). This means that eight of the novel T cell antigens were not targeted by IgE compared to five that were. The same holds true when comparing responses on the peptide level, or when considering the total number of responding T cells (Table 5). Overall, these data indicated that a sizeable fraction of the response against NTGAs is directed at proteins not recognized by IgE.

Example 6

This example includes a description of studies showing that IL-5 responses to novel antigens are made by memory T cells that can be detected directly ex vivo.

The data presented above indicated that almost two thirds (61%) of IL-5 producing T cell responses directed against pollen proteins were directed against the novel antigens, and that a majority of those responses targeted antigens not recognized by IgE. These responses were presumably the result of in vivo priming of T cells in the allergic patients, following pollen exposure. To exclude the possibility that these T cell response may be due to in vitro priming of T cells cultured with TG extract, it was examined whether the responding T cells were associated with either a memory or naïve phenotype. For this purpose two peptide pools were assembled: The TG P20 pool comprising the 20 most dominant peptides from known TG allergens identified in a previous study (12), accounting for about 90% of IL-5 responses detected against conventional IgE-reactive TG allergens in the study population; and an NTGA P19 pool comprising 19 of the most dominant peptides selected from IgE-unreactive Novel TG Antigens. These 19 peptides account for about 40% of the total IL-5 response against all novel antigens tested in our study population.

Figure 5:
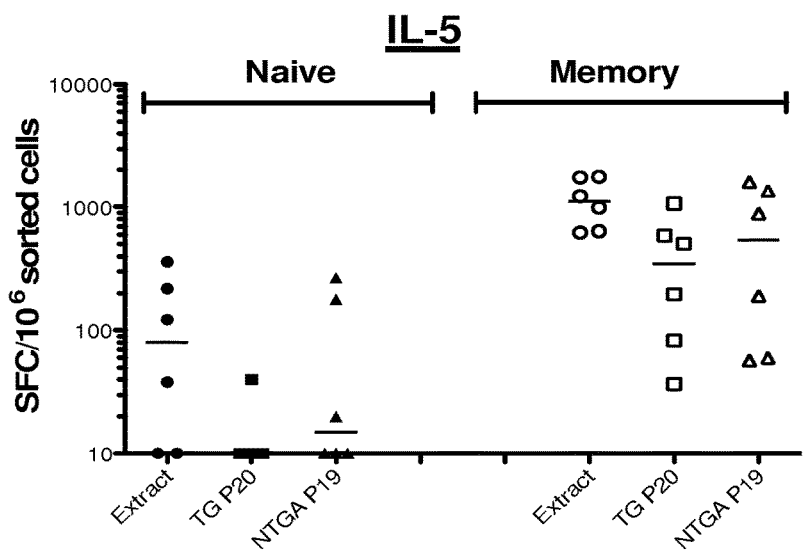
FIG. 5 shows that memory T cells are the source of IL-5 T cell responses after in vitro expansion. IL-5 production in naïve and memory T cells in response to TG extract (TG), the dominant known (TG P20) and novel peptide pools (NTGA P19) were measured after 14 days of expansion following TG stimulation in vitro (n=6).

PBMC from 6 allergic donors were sorted into memory (CD45RA−) and naïve (CD45RA+CCR7+) T cell subsets. Subsequently, cells from both subpopulations were stimulated in vitro with TG pollen extract, and tested after expansion for IL-5 production (FIG. 5). Responses to each stimulus were significantly higher in the memory population compared to the naïve population. In response to TG extract stimulation, the median SFC detected was 80 and 1,108 in the naïve and memory populations, respectively. The TG P20 elicited no response in the naïve population and a median of 350 SFC in the memory population. Stimulation with NTGA P19 resulted in a median of 12 SFC in the naïve and 540 in the memory subset. As expected, high amounts of IL-5 were detected in the naïve and memory population in response to PHA, indicating that the cells were viable and responsive to T cell stimulation. Thus, overall far fewer antigen-specific IL-5 producing cells were found in the naïve T cell subset compared to the memory subset (p=0.0002), signifying that the T cell responses to both the TG P20 and NTGA P19 peptide pools were derived from memory T cells. Of note, the two pools of peptides cover different fractions of the total response against the sets of antigens from which they were derived. The dominant known peptide pool (TG P20) is made up of the 20 most dominant peptides, which account for >90% of the total IL5 response detected against all known peptides. In contrast the dominant novel peptide pool (NTGA P19) only accounts for 40% of the total IL5 response directed against all novel peptides screened. Thus a direct quantitative comparison of the response against them is not possible.

Figure 6:
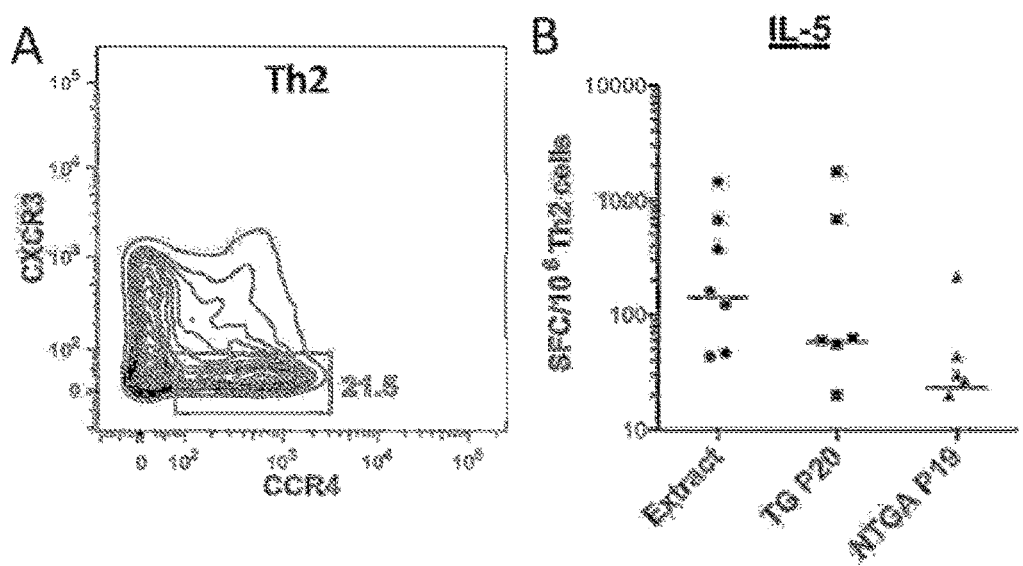
FIGS. 6A-6B show T cell responses against conventional and novel TG antigens can be detected directly ex vivo. A) FACS plot showing the Th2 T cell subset sorted based on expression of CXCR3 (Th1) and CCR4 (Th2). B) IL-5 production by Th2 cells from allergic donors in response to TG extract, the dominant known (TG P20) and novel (NTGA P19) peptide pools as measured ex vivo (n=8).

To further substantiate that the reactivity against the novel antigens was reflective of in vivo exposure, and not from primary responses induced in vitro, it was examined if responses against novel antigens could be detected directly ex vivo without any in vitro culture expansion. Since the frequency of antigen-specific precursor cells is very low, PBMCs from eight donors were presorted to obtain enriched Th1 or Th2 subpopulations, and cells were assessed for IL-5 production in response to TG extract and the dominant known and novel peptide pools in ELISPOT assays. As expected, IL-5 production for the Th1 subpopulation was not detectable for any of the stimuli except PHA. In contrast, as shown in FIG. 6, the Th2 subpopulation (CCR4+, CXCR3−) showed significant responses to each allergen stimulus compared to media alone (extract: p=0.01, TG20: p=0.03, NTGA19: p=0.01, Wilcoxon signed rank tests).

Example 7

This example includes a description of methods of determining in vivo efficacy of proteins and peptides of the invention, in particular, for treatment of allergy.

Peptides of the invention are evaluated for efficacy in treatment of allergy in a mouse model. In brief, six groups of BALB/cJ or HLA-transgenic mice are sensitized with repeat dosing of 1.5 micrograms of whole Timothy Grass (TG) allergen intranasally (in 25 uL) for 5×2 days over 2 weeks. This serves as a model system for investigation of allergic asthma caused by whole TG allergen.

The sensitized mice are left for one week before treatment with peptides of the invention. The treatment comprises intranasal delivery of TG peptides followed 30 minutes later by intranasal delivery of TG peptides daily for 5 days. Approximately 4 weeks later the mice are challenged with whole TG allergen for 2 days (2×15 ug/25 uL intranasally) and outcomes are measured 48 hours later. 5 doses of TG peptides are evaluated (10, 1, 0.1, 0.01 & 0.001 ug per peptide). Appropriate control experiments are conducted.

The outcomes measured are bronchial airway resistance following methacholine lung challenge (cm H20/mL/s), a measure of respiratory function, and a quantitation of inflammatory cells in the bronchoalveolar lavage (BAL) fluid.

For measurement of airway resistance, 48 hours after intranasal challenge over 2 days (2×15 ug) with Timothy Grass whole allergen, total respiratory system resistance (Rrs) is measured in response to intranasal saline and increasing doses of intravenous methacholine (MCh) using the Flexivent rodent ventilator. Using the resulting Rrs-MCh dose-response curves, indices of airway reactivity (Slope Rrs) and maximal degree of bronchoconstriction at 25 MCh mg/mL (Max Rrs @ 25 mg/mL) are measured. Values are means+/−SE.

For quantitation of inflammatory cells, bronchoalveolar lavage fluid (BALF) is assessed for total and differential inflammatory cell counts. Sections of lung tissue are stained with hematoxylin and eosin (H&E) and morphometrically quantified using a custom computerized analysis system (Northern Eclipse).

Example 8

This example includes a description of a clinical trial protocol of proteins and peptides of the invention for treatment of allergy.

Peptides of the invention are analyzed in a randomized, placebo-controlled, blind clinical trial for efficacy in reducing allergic symptoms. The study design of the clinical trial is in accordance with good clinical practice guidelines.

Baseline skin responses to Timothy Grass allergen for all subjects are established using a Baseline Challenge between 6 and 8 days prior to study medication administration. Two intradermal injections of 0.010 HEP (histamine equivalent prick) units of commercially available standard Timothy Grass allergen is administered, separated by a 30 minute time interval, into the volar surface of the left and right forearms respectively. Subjects are assessed to ensure that they experience a Late-Phase Skin Response (LPSR) to whole Timothy Grass allergen. The magnitude of the baseline reaction is recorded as follows: Eight hours after each injection the outline of any late-phase response is drawn onto the skin with a ballpoint pen. The longest and orthogonal diameters are measured and recorded for each response, and the area of the response in each arm is calculated. The average area of response in both arms of each subject is then calculated to provide the baseline reaction. Subjects who produced a suitable baseline reaction are assigned to dosing groups, randomized and entered into the Treatment Phase.

The Treatment Phase consists of a period of 21 days for each subject. During this period one group of subjects receives a single intradermal injection of either peptides of the invention (0.03, 0.3, 3, 12 nmol of each peptide per dose) or diluent placebo at Treatment Phase Visit 1 on day one. A cohort of 8 subjects receives treatment at each dose level (6 receives the peptides of the invention and 2 placebo). The first cohort of the intradermal group receives 0.03 nmol of each peptide in the mixture and each subsequent cohort in the group receives the next higher dose level.

Intradermal injections are made into the flexor surface of the left forearm. The total volume of the injection is 60 μL for all injections. After treatment, subjects have their skin response to whole allergen retested at Treatment Phase Visit 2 on day 21 (±3 days). Skin responses to Timothy Grass allergen are assessed by measurement of the late-phase responses 8 hours following intradermal administration of 0.010 HEP (histamine equivalent prick) units of commercially available standard Timothy Grass allergen as described above. The average area of response for both arms of each subject is then calculated as described above.

This average LPSR area after treatment is then compared to the baseline LPSR area for each subject. The overall change in LPSR area for all eight patients in each cohort is then evaluated.

Example 9

This example includes a discussion of results.

As disclosed herein, a third of TG allergic donors did not recognize any peptides derived from the 10 known IgE reactive TG allergens. This was puzzling as T cells from the same donors gave strong responses against the whole TG extract in the same sensitive ELISPOT assays. As a first explanation, the possibility that post-translational modifications might be essential for the recognition of some epitopes was considered. Such modifications would not be present in the peptides synthesized for our screening. However, a pilot study of peptides with hydroxylated prolines, which are thought to be prominent in some TG allergens (25), did not show any T cell reactivity at all. While this does not exclude that other post-translational modifications are present in T cell epitopes of TG, another hypothesis was analyzed, namely that T cells target conventional peptides from antigens other than the 10 known IgE reactive allergens. Analysis of T cells as disclosed herein led to the identification of 93 novel TG proteins, out of which 54 elicited Th2 responses. The recognition of these novel T cell antigens provides an explanation for the originally observed gap in reactivity between known allergens and whole TG extract.

Immunological characterization of the novel TG proteins revealed that a majority were both antibody and T cell reactive. Of prime interest, it was demonstrated that T cell responses against peptides derived from these novel antigens were potent inducers of IL-5 responses in PBMCs from TG allergic patients. The T cell population that produced IL-5 against these novel antigens originated from the memory Th2 cell subset and could be detected by direct ex vivo analysis. This demonstrated the relevance of these novel T cell antigens as targets of in vivo allergic responses. Interestingly, in contrast to the findings in allergic individuals, non-allergic donors had no or very weak IL-5 responses to both the known TG allergens and the novel antigens. Without being limited to any particular theory, this may also be true for other types of T cell responses, or non-allergic individuals may show an increased magnitude of 'tolerogenic' responses against novel TG antigens such as IL-10 producing Tregs.

Remarkably, strong IL-5 production was seen not only in response to IgE-reactive antigens but also to several antigens that were not targeted by IgE. This suggested that Th2 responses to an antigen were not necessarily linked to IgE reactivity. The idea of unlinked T cell help, meaning that T cells display a different antigen specificity than the B cells they affect, has been discussed in previous studies (18,20) and is also of great relevance to the immune response directed against the NTGAs. The natural structure of a pollen particle (or micro sized particles released upon hydration) provides physical linkage of various proteins, which are recognized by the immune system. Therefore, without being limited to any particular theory, the way in which pollen proteins are presented to B and T cells may allow for unlinked T cell help since the T cell-specific epitope derived from one antigen can be present on the same physical pollen particle as a second antigen recognized by B cells. As a result, the Th2 cell immune response directed against NTGAs may provide help for the allergic response directed against the major known IgE-reactive allergens present on the same pollen particle as the NTGAs.

The issue of whether T cell recognition is always necessarily linked to antibody recognition has broader significance in terms of the classic notion of linked recognition of an antigen by both helper T cells and antigen specific B cells. According to this notion, specific B cells internalize and process the antigen, leading to the presentation of antigen fragments bound by surface MHC class II molecules that can be recognized by specific T cells. This guarantees that the T cells deliver help to B cells specific for the same antigen (linked help). While in some instances it has been shown that T cells can only or preferentially provide help to B cells specific for the same protein (17,18) in other systems this was not the case (19, 20). It was found that two proteins that are present on the same particle could function together and T cells specific for one protein could provide help for B cells specific for the second protein (20). Therefore, it may be possible that as long as the antigen recognized by T cells is in some physical association with the target of B cell recognition (as in the case of a small virus, or a pollen particle), the integrity of the "antigenic bridge" is preserved.

Though the direct mechanisms by which such an immune-modulation may occur are unknown at this point, without being limited to any particular theory, there are several potential mechanism by which unlinked T cell help could potentially lead to the improvement of allergic symptoms. First, the data herein indicate that the majority of IL-5 responses are directed against NTGAs. Therefore down-regulating these responses should be of significant benefit in terms of reducing Th2-induced pathogenic effects. Secondly, induction of NTGA-specific Tregs or Th1 cells may help in the regulation, through by-stander mechanisms (26), of Th2 responses directed against known TG allergens present in the same pollen particle. Thirdly, the regulation of NTGA-specific Th2 responses may also result in downstream regulation of IgE and induction of blocking IgG antibody responses to known TG allergens, a hallmark of SIT treatment (27,28). Finally, induction of NTGA-specific Th1 or Treg cells may lead to NTGA-specific IgG production, which may interfere with IgE-induced mediator release and other immediate-type reactions by mechanisms such as steric hindrance, competition for antigen binding and inhibitory signaling through FcγRIIB (29,30). Overall, the data herein demonstrates that the novel antigens described herein are promising targets for a T cell focused specific immunotherapy, which could be safe for administration to higher risk patients such as asthmatics. As a result, therapies that specifically target T cell reactivity may provide a more efficacious and safer way to treat allergic patients, especially those suffering from severe asthma to whom current SIT regimens pose a significant risk of deleterious reactions.

This study is the first comprehensive transcriptomic- and proteomic-analysis of an inhaled allergen. 93 novel TG proteins were identified for which expression in the pollen itself was established, expanding the previously known set of such proteins by about an order of magnitude. The fact that 24 novel TG proteins targeted by IgE that do not overlap with the known IgE-reactive allergens were identified demonstrates this approach is a powerful tool for allergen discovery.

Example 10

This example includes a description of methods of determining in vivo efficacy of proteins and peptides of the invention, in particular, for treatment of allergy caused by an allergen unrelated to a protein disclosed herein, such as treatment of allergy by bystander suppression. A more complete description of such methods may be found in US patent application publication US2012/0100164A1 (e.g., examples 3, 4, 5 and 6).

Proteins/Peptides of the invention are evaluated for efficacy in prevention sensitization to Timothy Grass Pollen in a mouse model. In brief, naïve BALB/cJ or HLA-transgenic mice are treated daily by sublingual immunotherapy (SLIT) with about 10 µg of a protein or peptide of the invention for 2 weeks. Subsequently, the mice were immunized (made sensitized) by three weekly i.p. injections of either a mix of 10 µg of a protein or peptide of the invention and about 10 µg Timothy Grass Pollen extract or 10 µg of a protein or peptide of the invention alone, both adsorbed to aluminium hydroxide.

Subsequently, the mice are challenged intra-nasally (IN) with about 10 µg of Timothy Grass Pollen extract for four days so as to induce clinically relevant readouts of a Th2-driven immune response. The mice are sacrificed one day after the last challenge and blood, bronchoalveolar fluid (BAL), spleen and cervical lymph nodes are collected for analysis. This serves as a model system for investigation of preventing allergic rhinitis by bystander suppression of an allergic response caused by Timothy Grass allergens.

Clinically relevant readouts, such as airway hyper-reactivity and the fraction of eosinophils, are obtained on the last day of IN challenge. Airway hyper-reactivity is tested by using a whole body pletysmograph. Airflow obstruction was induced by challenging the mice with increasing concentrations of aerosolized metacholine. Pulmonary airflow obstruction was measured by enhanced pause (penh) in a period of 6 minutes after administration of metacholine. Differential counting of BAL fluid is performed by centrifuging BAL fluid and remove the supernatant. The remaining pellet was re-suspended in PBS and the fraction of eosinophils was determined by an automated cell counter (Sysmex).

T-cell proliferation assay is conducted by teasing spleen cells into single cell suspension and wash three times in medium. Cells are counted and adjusted to $1.67 \times 10^6$ cells/mL. $3 \times 10^5$ cells are added to each well of a 96 well flat-bottomed culture plate and the cells are stimulated by 0, 5, 25 and 125 µg/mL of a protein/peptide of the invention. The cells were cultured for 6 days at 37° C. and 5% CO2.

Proliferation was measured by adding 0.5 μCi of 3H-thymidine to each well for the last 18 hours of the culture period, followed by harvesting the cells and counting the incorporated radiolabel.

Down-regulation of T-cell response via bystander suppression is observed in groups of mice treated sublingually by a protein/peptide of the invention and where mice are co-sensitized with the protein/peptide of the invention and Timothy grass extract.

Example 11

This example includes a description of methods of determining in vivo efficacy of proteins and peptides of the invention, in particular, for treatment of allergy caused by an allergen unrelated to a protein disclosed herein, such as treatment of allergy by bystander suppression. A more complete description of the methods may be found in US patent application publication US2012/0100164A1 (e.g., examples 3, 4, 5 and 6).

Proteins/Peptides of the invention are evaluated for efficacy in treating allergy caused by Timothy Grass Pollen in a mouse model. In brief, naïve BALB/cJ or HLA-transgenic mice are sensitized by three weekly i.p. injections of about 10 μg Timothy Grass Pollen extract adsorbed to aluminium hydroxide. Subsequently, the mice are treated by sublingual immunotherapy (SLIT) with 100 to 250 μg of a protein/peptide of the invention for 4 weeks, followed by 2 weeks of intranasal challenge with 10 μg Timothy Grass Pollen extract together with about 10 μg of a protein/peptide of the invention or 10 mg Timothy Grass Pollen alone.

In both sets of studies, the mice were sacrificed one day after the last challenge and blood, bronchoalveolar fluid (BAL), spleen and cervical lymph nodes were collected for analysis.

Evaluating Clinically Relevant Readouts:

Clinically relevant readouts, such as sneezes, airway hyper-reactivity and presence of eosinophils, are obtained on the last day of IN challenge.

Sneezing:

The mice are observed in an 8 min-period after intranasal administration of Timothy Grass Pollen Extract and the numbers of sneezes are counted during this period.

Airway Hyper-Reactivity:

Using a whole body pletysmograph, airflow obstruction is induced by increasing concentrations of aerosolized metacholine. Pulmonary airflow obstruction is measured by enhanced pause (penh) in a period of 6 minutes after administration of metacholine.

Differential Counting of BAL Fluid:

The BAL fluid is centrifuged and the supernatant is removed. The pellet was re-suspended in PBS and the fraction of eosinophils is determined by an automated cell counter (Sysmex).

Down-regulation of clinically relevant readouts (such as no of eosinophils in BAL) via bystander suppression are observed in groups of mice treated sublingually by a protein/peptide of the invention and where the mice are intranasally challenged to both the protein/peptide of the invention and Timothy grass extract.

TABLE 1

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 1 | M.693 | 1 | .........................SKYLGKGVLKAVDNVNSIIGPLIGKDPTEQTELDNFMVHQLDGTKNEWGCKQKLGANAILAAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWHYAKMTEEIGEQVQIVGDDLLVTNPTRVAAKAIAEKSGAAAVYAGLKFRAPVEPYQLLRIEEELGAAAVYAGLKFRAPVEPY |
| 1 | M.692 | 2 | .........................DYLGKGVLKAVDNVNSIIGPALIGKDPTEQTELDNFMVHQLDGTKNEWGCWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWHYAKMTEEIGEQVQIVGDDLLVTNPTRVAKAIAEKSCNALLLKVNQIGSVTESIEAVKMSKRAGWGMTSHRSGETEDTFIADLAVGLSTGQIKTGAPCRSERLAKYNQLLRIEEELGAAAVYAGLKFRAPVEPY |
| 1 | M.125 | 3 | .........................GNPTVEVDVCCSDGTFARAAVPSGASTGVYEALELRDGGSDYLGKGVLKGNRANVELFHIAVLLA |
| 1 | M.714 | 4 | .........................PPPPAMAATIQSVKARQIFDSRGNPTVEVDVCCSDGTFARAAVPSGASTGVYEALELRDGGSKYLGKGVLKAVDNVNSIIGPALIGKDPTEQTELDNFMVHQLDGTKNEWGCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWHYAKMTEEIGEQVQIVGDDLLVTNPTRVAKAIAEKSCNALLLKVNQIGSVTESIEAVKMSKRAGWGMTSHRSGETEDTFIADLAVGLSTGQIKTGAPCRSERLAKYNQLLRIEEELGAAAVYAGLKFRA |
| 1 | M.721 | 5 | .........................GNPTVEVDVCCSDGTFARAAVPSGASTGVYEALELRDGGSDYLGKGVLKAVDNVNSIIGPALLGKDPTEQTELDNFMVHQLDGTKNEWGCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWHYAKMTEEIGEQVQIVGDDLLVTNPTRVAKAIAEKSCNALLLKVNQIGSVTESIEAVKMSKRAGWGMTSHRSGETEDTFIADLAVGLSTGQIKTGAPCRSERLAKYNQLLRIEEELGAAAVYAGLKFRA |
| 1 | M.705 | 6 | .........................DYLGKGVLKAVDNVNSIIGPALLGKDPTEQTELDNFMVHQLDGTKNEWGCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWHYAKMTEEIGEQVQIVGDDLLVTNPTRVAKAIAEKSCNALLLKVNQIGSVTESIEAVKMSKRAGWGMTSHRSGETEDTFIADLAVGLSTGQIKTGAPCRSERLAKYNQLLRIEEELGAAAVYAGLKFRAPVEPY |
| 1 | M.591 | 7 | .........................ANLAGNKQLVLPVPAFNVINGGSHAFNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWHYAKMTEEIGEQVQIVGDDLLVTNPTRVAKAIAEKSCNALLLKVNQIGSVTESIEAVKMSKRQGWGMTSHRSGETEDTFIADLAVGLSTGQIKTGAPCRSERLAKYNQLLRIEEELGAAAVYAGLKFRA |
| 1 | M.418 | 8 | .LRFPKASRSIPPPPAMAATIQSVKARQIFDSRGNPTVEVKVCCSDGTFARAAVPSGASTGVYEALELRDGGSDYLGKGVLKAVDNVNSIIGPALLGKDPTEQTELDNFMVHQLDGTKNEWGCKQKLGANAILAVSLAVCKAGALVKKIPLYQHIANLAGNKQL |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 1 | M.689 | 9 | ............RSIPPPPAMAATIQSVKARQIFDSRGNPTVEVDCCSDGTFARAAVPSGASTGVYEALELRDGGSDYLGKVLKAVDNV NSIIGPALLGKDPTEQTELDNFMVHQLDGTKNEWGWCKQKLGANAILAVSLAVCKAGALVKKIPLYQHIANLAGNKQLVLPVPAFNV INGGSHAGNKLAMQEFMILPTGASSFKEAMKGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWVHYAKMTEEIGEQVQIVGDDLL VTNPTRVVAKAIAEKSCNALLLKVNQIGSVTESIEAVKMSKRQGWVMTSHRSGETEDTFI |
| 1 | M.644 | 10 | ..............................................................................SKYLGKVLKAVDNV NSIIGPALIGKDPTEQTELDNFMVHQLDGTKNEWGWCKQKLGANAILAVSLAVCKAGALVKKIPLYQHIANLAGNKQLVLPVPAFNV INGGSHAGNKLAMQEFMILPTGASSFKEAMKGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWVHYAKMTEEIGEQVQIVGDDLL VTNPTRVVAKAIAEKSCNALLLKVNQIGSVTESIAVKMSSKRAGWVMTSHRSGETEDTFIADLAVGLSTGQIKTGA |
| 1 | M.414 | 11 | ...ASRSIPPPPAMAATIQSVKARQIFDSRGNPTVEVDCCSDGTFARAAVPSGASTGVYEALELRDGGSDYLGKVLKAVDNV NSIIGPALIGKDPTEQTELDNFMVHQLDGTKNEWGWCKQKLGANAILAVSLAVCKAGALVKKIPLYQHIANLAGNKQL |
| 1 | M.624 | 12 | ............GNPTVEVDCCSDGTFARAAVPSGASTGVYEALELRDGGSDYLGKVLKAVDNV NSIIGPALIGKDPTEQTELDNFMVHQLDGTKNEWGWCKQKLGANAILAVSLAVCKAGALVKKIPLYQHIANLAGNKQLVLPVPAFNV INGGSHAGNKLAMQEFMILPTGASSFKEAMKGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWVHYAKMTEEIGEQVQIVGDDLL VTNPTRVVAKAIAEKSCNALLL |
| 1 | M.617 | 13 | ...........................TVEVDVCCSDGTFARAAVPSGASTGVYEALELRDGGSDYLGKVLKAVDNV NSIIGPALIGKDPTEQTELDNFMVHQLDGTKNEWGWCKQKLGANAILAVSLAVCKAGALVKKIPLYQHIANLAGNKQLVLPVPAFNV INGGSHAGNKLAMQEFMILPTGASSFKEAMKGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWVHYAKMTEEIGEQVQIVGDDLL VTNPTRVVAKAIAEKSCNALLL |
| 1 | M.704 | 14 | .........................TVEVDVCCSDGTFARAAVPSGASTGVYEALELRDGGSDYLGKVLKAVDNV NSIIGPALIGKDPTEQTELDNFMVHQLDGTKNEWGWCKQKLGANAILAVSLAVCKAGALVKKIPLYQHIANLAGNKQLVLPVPAFNV INGGSHAGNKLAMQEFMILPTGASSFKEAMKGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWVHYAKMTEEIGEQVQIVGDDLL VTNPTRVVAKAIAEKSCNALLLKVNQIGSVTESIEAVKMSKRAGWVMTSHRSGETEDTFIADLAVGLSTGQIKTGAPCRSERLAKYN QLLRIEEELFAAAVYAGL |
| 1 | M.331 | 15 | ..........GNPTVEVDCCSDGTFARAAVPSGASTGVYEALELRDGGSDYLGKVLKAVDNV NSIIGPALIGKDPTEQTELDNFMVHQLDGTKNEWGWCKQKVFFNISADADAGAVAR |
| 1 | M.604 | 16 | .........................AILAVSLAVCKAGALVKKIPLYQHIANLAGNKQLVLPVPAFNV INGGSHAGNKLAMQEFMILPTGASSFKEAMKGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWVHYAKMTEEIGEQVQIVGDDLL VTNPTRVVAKAIAEKSCNALLLKVNQIGSVTESIEAVKMSKRAGWVMTSHRSGETEDTFIADLAVGLSTGQIKTGAPCRSERLAKYN QLLRIEEELGAAAVYAGL |
| 1 | M.291 | 17 | ............GNPTVEVDCCSDGTFARAAVPSGASTGVYEALELRDGGSDYLGKVLKAVDNV NSIIGPALIGKDPTEQTELDNFMVHQLDGTKNEWGWCKQKLGAN |
| 1 | M.151 | 18 | ...........IDPSSSSSPAMAATIQSVKARQIFDSRGNPTVEVDCCSDGTFARAAVPSGASTGVYEALELRDGGS |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 1 | M.498 | 19 | ........IDPSSSSSPAMAATIQSVKARQIFDSRGNPTVEVDVCCSDGTFARAAVPSGASTGVYEALELRDGGSDYLGKGVLKAVDNV NSIIGPALIGKDPTEQTELDNFMVHQLDGTKNEWGWCKQKLGANAILAVSLAVCKAGALVKKIPLYQHIANLAGNKQLVLPVPAFNV INGGSHAGNKLAMQEFMILPTGASSFKEAMKMGVEVYHNLKSVIKKKYGQDATNV |
| 1 | M.561 | 20 | ..........................................................VSLAVCKAGALVKKIPLYQHIANLAGNKQLVLPVPAFNV INGGSHAGNKLAMQEFMILPTGASSFKEAMKMGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWHYAKMTEEIGEQVQIVGDDLL VTNPTRVAKAIAEKSCNALLLKVNQIGSVTESIEAVKMSKRAGWVMTSHRSGETEDTFIA |
| 1 | M.399 | 21 | ALRFPKASRSIPPPPAMAATIQSVKARQIFDSRGNPTVEVDVCCSDGTFARAAVPSGASTGVYEALELRDGGSDYLGKGVLKAVDNV NSIIGPALIGKDPTEQTELDNFMVHQLDGTKNEWGWCKQKLGANAILAVSLAICKAGASVKKIPLYQ |
| 1 | M.603 | 22 | ..........................................................VSLAVCKAGALVKKIPLYQHIANLAGNKQLVLPVPAFNV INGGSHAGNKLAMQEFMILPTGASSFKEAMKMGVEVYHNLKSVIKKKYGQDATNVGDEGGFAPNIQENKEGLELLKTAIEKAGYTGK VVIGMDVAASEFYGEKDQTYDLNFKEENNDGSQKISGDSLKNVYKSFVSEYPIVSIEDPFDQDDWHYAKMTEEIGEQVQIVGDDLL VTNPTRVAKAIAEKSCNALLLKVNQIGSVTESIEAVKMSKRAGWVMTSHRSGETEDTFIADLAVGLSTGQIKTGAPCRSERLAKYN QLLRIEEELGAAAVYAGLKFRA |
| 1 | M.226 | 23 | ALRFPKASRSIPPPPAMAATIQSVKARQIFDSRGNPTVEVDVCCSDGTFARAAVPSGASTGVYEALELRDGGSDYLGK |
| 2 | M.636 | 24 | ..........................................................YGFPPIVQRFLEGAS SIDNHFRTASFEKNIPVLLGLLSVMNVSFLGYPARAILPYSQALEKLAPHIQQLSMESNGKGVSIDGVPLPYEAGEIDFGEPGTNGQ HSFYQLIHQGRVIPCDIPGVIKSQQPVYLKGETVSNHDELMSNFFAQPDALAYGKNPEQLRSENVSENLIPHKTFKGNRPLSFLLS SLSAYEIGQLLAIYEHRIAVQGFIWGINSFDQWGEVLGKSLASQVRKQLHASRMEGKPVEGFNPSSASLLARYLAVEPSTPYDTTVL PKV |
| 2 | M.473 | 25 | ..........................ENRSVLHVALRAPRDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWGGRYSVCSAVGVLPLSLQYGF |
| 2 | M.437 | 26 | ..........................................VKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWGGRYSVCSAVGVLPLSLQYGFP |
| 2 | M.634 | 27 | ..........................KLAEAAKLDEKIEKMFNGEKINSTENRSVLHVALRAPRDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWGGRYSVCSAVGVLPLSLQYGFPIVQRFLEGAS SIDNHFRTASFEKNIPVLLGLLSVMNVSFLGYPARAILPYSQALEKLAPHIQQLSMESNGKGVSIDGVPLPYEAGEIDFGEPGTNGQ HSFYQLIHQGRVIPCDFYDANK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 2 | M.676 | 28 | ............................KLAEAAKLDEKIEKMFNGEKINSTENRSVLHVALRAPRDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWVGGRYSVCSAVGVLPLSLQYGFPIVQRFLEGAS SIDNHFRTASFEKNIPVLLGLLSVWNVSFLGYPARAILPYSQALEKLAPHIQQLSMESNGKGVSIDGVPLPYEAGEIDFGEPGTNGQ HSFYQLIHQGRVIPCDFIGVIKSQQPVYLKGETVSNHDELMSNFFAQPDALAYGKTPEQ |
| 2 | M.422 | 29 | ............................NGEKINSTENRSVLHVALRAPRDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAV |
| 2 | M.431 | 30 | ............................NGEKINSTENRSVLHVALRAPRDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVST |
| 2 | M.387 | 31 | ............................RDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVST |
| 2 | M.722 | 32 | ............................IKQF SETFRSGSWVGTGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWVGGRYSVCSAVGVLPLSLQYGFPIVQRFLEGAS SIDNHFRTASFEKNIPVLLGLLSVWNVSFLGYPARAILPYSQALEKLAPHIQQLSMESNGKGVSIDGVPLPYEAGEIDFGEPGTNGQ HSFYQLIHQGRVIPCDFIGVIKSQQPVYLKGETVSNHDELMSNFFAQPDALASRKTPAPLRSENVSENLIPHKTFKGNRPSLSFLLS SLSAYEIGQLLAIYEHRIAVQGFIWGINSFDQWGVELGKSLASQVRKQLHASRMEGKPVEGFNPSSASLLARYLAVEPSTPYDTTVL PKV |
| 2 | M.610 | 33 | ............................IKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWVGGRYSVCSAVGVLPLSLQYGFPIVQRFLEGAS SIDNHFRTASFEKNIPVLLGLLSVWNVSFLGYPARAILPYSQALEKLAPHIQQLSMESNGKGVSIDGVPLPYEAGEIDFGEPGTNGQ HSFYQLIHQGRVIPCDFIGVIKSQQPVYLKGETVSNHDELMSNFFAQPDALAYGKTPEHSR |
| 2 | M.574 | 34 | AEFEGVFLDFARQQATTETVDKLFKLAEAAKLKEKIEKMFNGEKINSTENRSVLHVALRAPRDAVINSDGVNVVPEVWSVKDKIKQF SETFRSGSWVGATGKPLTNVVSVGIGGSFLGPLFVHTALQTDPEAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWVGGRYSVCSAVGVLPLSLQYGFPIVQRFLEGAS SIDNHFRTASFEKNIPVLLGLLSV |
| 2 | M.531 | 35 | ............................EAAESAKGRQLRFLANVDPVDVARSIKDLDPETTLVVVSKTFT TAETMLNARTIKEWIVSSLGPQAVSKHMIAVSTNLKLVKEFGIDPNNAFAFWDWVGGRYSVCSAVGVLPLSLQYGFPIVQRFLEGAS SIDNHFRTASFEKNIPVLLGLLSVWNVSFLGYPARAILPYSQALEKLAPHIQQLSMESNGKGVSIDGVPLPYEAGEIDFGEPGTNGQ HSFYQLIHQGRVIPCDFIGVIKSQQPVYLK |
| 3 | M.305 | 36 | ......ILLVFAETAEPEVKVVDLTILSPDRPDLVLPIPFVADEKGYAFALKDGSTYSFRFSFIVSNNIVSGLKYTNTVWKTGVREN QKMMLG |
| 3 | M.282 | 37 | LLGQVDTEQLGETAEPEVKVVDLTILSPDRPDLVLPIPFVADEKGYAFALKDGSTYSFRFSFIVSNNIVSGLKYTNTVWKTGVREN QKMMLG |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 3 | M.271 | 38 | .........ETAEPEVKVVDLTILSPDRRPDLVLPIPFVADEKGYAFALKDGSTYSFRFSFIVSNNIVSGLKYTNTVWKTGVRVEN QKMMLGTFSPQPEP |
| 3 | M.159 | 39 | QKMMLGTFSPQPEPYIYVGEEETTPAGIFARGSYSAKLKFVDDDGKVYLEMSYYFEIRKDWPTGQ..................................VEN |
| 3 | M.83 | 40 | ........IYVGEEETTPAGIFARGSYSAKLKFVDDDGKVYLEMSYYFEIRKDWPTGQ |
| 3 | M.348 | 41 | .........YSFRFSFIVSNNIVSGLKYTNTVWKTGVRVEN QKMMLGTFSPQPEPYIYVGEEETTPAGIFARGSYSAKLKFVDDDGKVYLEMSYYFEIRKDWPTGQ |
| 3 | M.285 | 42 | .........YSFRFSFIVSNNIVSGLKYTNTVWKTGVRVEN QKMMLGTFSPQPEPYIYVGEEETTPAGIFARGSYSAKLKFVDDDGKVYLEMSYYFEIRKDWP |
| 3 | M.288 | 43 | .........ETAEPEVKVVDLTILSPDRRPDLVLPIPFVADEKGYAFALKDGSTYSFRFSFIVSNNIVSGLKYTNTVWKTGVRVEN QKMMLGTFSPQPEPYIYVGEE |
| 3 | M.287 | 44 | QKMMLGTFSPQPEPYIYVGEEETTPAGIFARGSYSAKLKFVDDDGKVYLEMSYYFEIRKDWPTGQ.........WKTGVRVEN |
| 3 | M.212 | 45 | EQLGETAEPEVKVVDLTILSPDRRPDLVLPIPFVADEKGYAFALKDGSTYSFRFSFIVSNNIVSGLKYTNTVWKTGVR |
| 4 | M.715 | 46 | ....MKTIFDFESIKKLLASPKFSFCFDGLHGVAGAYAKRMFVDELGASESSLLNCVPKEDFGGGHPDPNLTYAKELVERMGLGKS SSNVEPPEFGAAADGDADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFEYKDPVDGSVSKHQGIRYLFGDGSRLVFRLSGTGSVGATIRIYIEQYEKDSS KTGRESSDALSPLVDVALKLSKIKEYTGRSAPTVIT |
| 4 | M.725 | 47 | ....MKTIFDFESIKKLLASPKFSFCFDGLHGVAGAYAKRMFVDELGASESSLLNCVPKEDFGGGHPDPNLTYAKELVERMGLGKS SSNVEPPEFGAAADGDADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFEYKDPVDGSVSKHQGIRYLFGDGSRLVFRLSGTGSVGATIRIYIEQYEKDSS KTGRESSDALSPLVDVALKLSKIKEYTGRSAPTVIT |
| 4 | M.694 | 48 | PSPFNSRTIFDFESIKKLLASPKFSFCFDGLHGVAGAYAKRMFVDELGASESSLLNCVPKEDFGGGHPDPNLTYAKELVERMGLGKS SSNVEPPEFGAAADGDADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFEYKDPVDGSVSKHQGIRYLFGDGSRLVFRLSGTGSVGATIRIYIEQYEKDSS KTGRESSDALSPLVDVALKLSKIKEYTGRSAPTVIT |
| 4 | M.701 | 49 | PSPFNSRTIFDFESIKKLLASPKFSFCFDGLHGVAGAYAKRMFVDELGASESSLLNCVPKEDFGGGHPDPNLTYAKELVERMGLGKS SSNVEPPEFGAAADGDADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFEYKDPVDGSVSKHQGIRYLFGDGSRLVFRLSGTGSVGATIRIYIEQYEKDSS KTGRESSDALSPLVDVALKLSKIKEYTGRSAPTVIT |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 4 | M.595 | 50 | ...KLMKTIFDFESIKKLLASPKFSFCFDGLHGVAGAYAKRMFVDELGASESSLLNCVPKEDFGGGHPDPNLTYAKELVERMGLGKS SSNVEPPEFGAAADGADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPLVDVALKLSKIKEYTGRSAPTVIT LMANLVKMQSALSDVNKLIKEIQPDVAEVVSADEFYKDPVDGSVS |
| 4 | M.718 | 51 | ...KLMKTIFDFESIKKLLASPKFSFCFDGLHGVAGAYAKRMFVDELGASESSLLNCVPKEDFGGGHPDPNLTYAKELVERMGLGKS SSNVEPPEFGAAADGADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPLVDVALKLSKIKEYTGRSAPTVIT |
| 4 | M.720 | 52 | ...KLMKTIFDFESIKKLLASPKFSFCFDGLHGVAGAYAKRMFVDELGASESSLLNCVPKEDFGGGHPDPNLTYAKELVERMGLGKS SSNVEPPEFGAAADGADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPLVDVALKLSKIKEYTGRSAPTVIT |
| 4 | M.723 | 53 | ...KTIFDFESIKKLLASPKFSFCFDGLHGVAGAYAKRMFVDELGASESSLLNCVPKEDFGGGHPDPNLTYAKELVERMGLGKS SSNVEPPEFGAAADGADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPLVDVALKLSKIKEYTGRSAPTVIT |
| 4 | M.648 | 54 | ...KLMKTIFDFESIKKLLASPKFSFCFDGLHGVAGAYAKRMFVDELGASESSLLNCVPKEDFGGGHPDPNLTYAKELVERMGLGKS SSNVEPPEFGAAADGADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPL |
| 4 | M.662 | 55 | ...NSRTIFDFESIKKLLASPKFSFCFDGLHGVAGAYAKRMFVDELGASESSLLNCVPKEDFGGGHPDPNLTYAKELVERMGLGKS SSNVEPPEFGAAADGADRNMVLGKRFFVTPSDSVAIIAANAVQSIPYFASGLKGVARSMPTSAALDVVAKNLNLKFFEVPTGWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPLVDVALKLSKIKEYTG |
| 4 | M.576 | 56 | ................................................................................GWKFF GNLMDAGMCSVCGEESFGTGSDHIREKDGIWAVLAWLSIIAYKNKDNLGGDKLVSVEDIVLQHWATYGRHYYTRYDYENVDAEAAKE LMANLVKMQSALSDVNKLIKEIQPDVAEVVSADEFYKDGSRLVFRLSGTGSVGATIRIYIEQYEKDSS KTGRESSDALSPLVDVALKLSKIKEYTG |
| 5 | M.618 | 57 | ..................................DEYLAAVAKARRKLRGLIAEKNCAPLMLRIAWHSAGTFDVATKTGPFGTMRCPAELA HGANAGLDIAVRLLEPIKEQVPILSYADFYQLAGVVAVEITGGPEVPFHPGRQDKTEPPPEGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 5 | M.631 | 58 | ....................GAMAAKCYPTVSDEYLAAVAKARRKLRGLIAEKNCAPLMLRIAWHSAGTFDVATKTGPFGTMRCPAELA HGANAGLDIAVRLLEPIKEQVPILSYADFYQLAGVVAVEITGGPFHPGRQDKTEPPPEGRLPDATLGSDHLRQVFTAQMGLSDQ |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 5 | M.682 | 59 | DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 5 | M.421 | 60 | ..........KCYPTVSDEYLAAVAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 5 | M.654 | 61 | ..........KCYPTVSDEYLAAVAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVALSGGHTLG |
| 5 | M.393 | 62 | ..........AKCYPTVSDEYLAAVAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 5 | M.669 | 63 | ..........VAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVAL |
| 5 | M.625 | 64 | ..........VAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 5 | M.655 | 65 | ..........AFPHPIGAMAAKCYPTVSDEYLAAVAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 5 | M.524 | 66 | HPDPQPHSSPTRAEFPIGAMAAKCYPTVSDEYLAAVAKARRKLRGLIAEKNCAPLMLRIAWHSAGTFDVATKTGGPFGTMRCPAELA HGANAGLDIAVRLLEPIKEQVPILSYADFYQLAGVVAVEITGGPFVPFHPGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 6 | M.570 | 67 | ..........GGPEVPFHPGRQDKTEPPPEGRLPDATLGSDHLRQVFTAQMGLSDQ DIVALSGGHTLGRCHKERSGFEGAWTANPLIFDNSYFTELLTGEKEGLLQLPTDKTLLTDPAFRPLVDKYAADEDAFFADYAEAHLK LSELGFGEATEGCC |
| 6 | M.341 | 68 | ..........AGLPQISDNEKSGFISLVSRYLSGEEEHIEWPKIHTPTDEVVPYDTIDAP PEDLEATKALLDKLAVLKLNGGLGTTMGCTGPKSVIEVRNGFTFLDLIVIQIESLNKKYGSNVPLLLMNSFNTHEDTLKIVEKYANS SIDIHTFNQSQYPRVVADEFLPWPSKGKTDKDGWYPPGHGDIFPSLMNSGLKDLLLSQGKEYVFIANSDNLGAIVDMKIILNKLIHKQ NEYCMEVTPKTLADVKGGTLISYEGRVQLLELAQVPDAHVDEFKSIEKFKLFNTNN |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 6 | M.342 | 69 | KVLQLETAAGAAIRFFDHAIGINVPRSRFLPVKATSDLQLVQSDLYTLVDGFVTRNSARTDPSNPSIELGPEFKKVGCFLGRFKSIP...EVDGV SIVELDSLKVSGDVWFGSGIVLK |
| 6 | M.450 | 70 | KVLQLETAAGAAIRFFDHAIGINVPRSRFLPVKATSDLQLVQSDLYTLVDGFVTRNSARTDPSNPSIELGPEFKKVGCFLGRFKSIP...EVDGV SIVELDSLKVSGDVWFGSGIVLK |
| 6 | M.434 | 71 | ...........................................................................................FIANSDNLGAIVDMKIINHLIIHKQ NEYCMEVTPKTLADVKGGTLISYEGRVQLLEIAQYPDAHVDEFKSIEKFKIFNTNNLWVNLKAIKRLVEADALKMEIIPNPKEVDGV KVLQLETAAGAAIRFFDHAIGINVPRSRFLPVKATSDLQLVQSDLYTLVDGFVTRNSARTDPSNPSIELGPEFKK |
| 6 | M.639 | 72 | TLLFPHTQISLPSVRTRKHLAATMADEKLAKLREAVAGLPQISDNEKSGFISLVSRYLSGDEEHIEMPKIHTPTDEVVPYDTIDAP PEDLEATKALLNKLAVLKLNGGLGTMGCTGPKSVIEVRNGFTFLDLIVLQIESLNKKYGSNVPLLLMNSFNTHEDTLKIVEKYANS SIDIHTFNQSQYPRVVADEFLPWPSKGKTDKDGWYPPGHGDIFPSLMNSGKLDLLLSQGKEYVFIANSDNLGAIVDMKIINHLIIHKQ NEYCMEVTPKTLADVKGGTLISYEGRVQLLEIAQYPDAHVDEFKSIEKFKIFNTNNLWVNLKAIKRLVEADALKMEIIPNPKEVDTV NFF |
| 6 | M.555 | 73 | ...........................................................................................YDTVDAP PEDLEATKALLNKLAVLKLNGGLGTMGCTGPKSVIEVRNGFTFLDLIVLQIESLNKKYGSNVPLLLMNSFNTHEDTLKIVEKYANS SIDIHTFNQSQYPRVVADEFLPWPSKGKTDKDGWYPPGHGDIFPSLMNSGKLDLLLSQGKEYVFIANSDNLGAIVDMKIINHLIIHKQ NEYCMEVTPKTLADVKGGTLISYEGRVQLLEIAQYPDAHVDEFKSIEKFKIFNTNNLWVNLKAIKRLVEADALKMEIIPNPKEVDTV NFF |
| 6 | M.546 | 74 | ...EDLEATKALLDKLAVLKLNGGLGTMGCTGPKSVIEVRNGFTFLDLIVLQIESLNKKYGSNVPLLLMNSFNTHEDTLKIVEKYANS SIDIHTFNQSQYPRVVADEFLPWPSKGKTDKDGWYPPGHGDIFPSLMNSGKLDLLLSQGKEYVFIANSDNLGAIVDMKIINHLIIHKQ NEYCMEVTPKTLADVKGGTLISYEGRVQLLEIAQYPDAHVDEFKSIEKFKIFNTNNLWVNLKAIKRLVEADALKMEIIPNPKEVDTV NFFRV |
| 7 | M.606 | 75 | LVFEGKDETVDLEVFNFTGAGGVALAMYNTDESIQFAEASMAIAYEKKMPLYLSTKNTILKKYDGRFKDIFQAVVEADWKSKYEAA...GKLR GIMYEHRLIDDMVAYALKSEGGYVWACKNYDGDVQSDFLAQGFGSLGLMTSVLMCPDGKNIEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN |
| 7 | M.628 | 76 | LVFEGKDETVDLEVFNFTGAGGVALAMYNTDESIQFAEASMAIAYEKKMPLYLSTKNTILKKYDGRFKDIFQAVVEADWKSKYEAA ATDAVLKGPGKLR |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 7 | M.248 | 77 | GIWYEHRLIIDDMVAYALKSEGGYVWACKNYDGDVQSDFLAQGFGSLGLMTSVLMCPDGKNIEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN |
| 7 | M.466 | 78 | .................................................................YPLFCRFKDIFQAVVEADWKSKYEAA GIWYEHRLIIDDMVAYALKSEGGYVWACKNYDGDVQSDFLAQGFGSLGLMTSVLMCPD................................ |
| 7 | M.328 | 79 | ...........................................................................IEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN........STNS |
| 7 | M.695 | 80 | ............................PPFSLCLLPSGTVFREPIICKNVPKLVPGWTKPICIGRHAFGDQYRATDAVLKGPGKLR LVFEGKDETVDLEVFNFTGAGGVALAMYNTDESIQGFAEASMAIAYEKKWPLYLSTKNTILKKYDGRFKDIFQAVVEADWKSKYEAA GIWYEHRLIIDDMVAYALKSEGGYVWACKNYDGDVQSDFLAQGFGSLGLMTSVLMCPDGKNIEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN |
| 7 | M.658 | 81 | YNVAIKCATITPDEDEVKEFNLKQMWRSPNGTIRNIINGTVFREPIICKNVPKLVPGWTKPICIGRHAFGDQYRATDAVLKGPGKLR LVFEGKDETVDLEVFNFTGAGGVALAMYNTDESIQGFAEASMAIAYEKKWPLYLSTKNTILKKYDGRFKDIFQAVVEADWKSKYEAA GIWYEHRLIIDDMVAYALKSEGGYVWACKNYDGDVQSDFLAQGFGSLGLMTSVLMCPDGKNIEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN |
| 7 | M.560 | 82 | ............DETVDLEVFNFTGAGGVALAMYNTDESIQGFAEAASMAIAYEKKWPLYLSTKNTILKKYDGRFKDIFQAVVEADWKSKYEAA GIWYEHRLIIDDMVAYALKSEGGYVWACKNYDGDVQSDFLAQGFGSLGLMTSVLMCPDGKNIEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN |
| 7 | M.548 | 83 | ............DETVDLEVFNFTGAGGVALAMYNTDESIQGFAEASMAIAYEKKWPLYLSTKNTILKKYDGRFKDIFQAVVEADWKSKYEAA GIWYEHRLIIDDMVAYALKSEGGYVWACKNYDGDVQSDFLAQGFGSLGLMTSVLMCPDGKNIEAEAAHGTVTRHFRVHQKGGETSTNS IASIFAWTRGLAHRAKLDDNARLLDFTQKLEDACVGTVESGKMTKDLALLVHGSSKVTRGDYLNTEEFIDAVAAELQSRLAAN |
| 7 | M.269 | 84 | ...........................................................................................STNS IASIFAWTRGLAHRAKLDDNARLLDFTQKLEDACVGTVESGKMTKDLALLVHGSSKVTRGDYLNTEEFIDAVAAELQSRLAANCV |
| 8 | M.728 | 85 | ........................ILVTPDGNFNTAGMLVVQSGCWTMLKGGATSFAAGKGELFFET NVTAELMVDSMSLQPFSFEEWKSHRHESIAKERKKKVKITVHGSDGKVLPDAELSLERVAKGFPLGNAMTKEILDIPEYEKWFTSRF TVATMENEMKWYSTEYDQNQELYEIPDKMLALAEKYNISVRGHNVFWDDQSKQMDWVSKLSAPQLKKAMEKRMKNVVSRYAGKLIHW DVLNENLHYSFFEDKLGKDASAEVFKEVAKLDDKPILFMNEYNTIEEPNDAAPLPTKYLAKLKQIQSYPGNSKLKYGIGLESHFDTP NIPYVRGSLDTLAQAKVPIWLTEIDVKKGPKQVEYLEEVMREGFAHPGVKGIVLMGAWHAKECYVMCLTDKNFKNLPVGDVVDKLIT EWKAVPEAKTDDKGVFEAELFHGEYNVTVKHKSLKEPLMHTVDLDSKSEATIRAKK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 8 | M.653 | 86 | ................................GNFNTAGMLVVQSGCWTMLKGGATSFAAGKGELFFET NVTAELMVDSMSLQPFSFEEWKSHRHESIAKERKKKKVKITVHGSDGKVLPDAELSLERVAKGFPLGNAMTKEILDIPEYEKWFTSRF TVATMENEMKWYSTEYDQNQELYEIPDKMLALAEKYNISVRGHNVFWDDQSKQMDWVSKLSAPQLKKAMEKRMKNVVSRYAGKLIHW DVLNENLHYSFFEDKLGKDASAEVFKEVAKLDDKPILFMNEYNTIEEPNDAAPLPTKYLAKLKQISYPGNSKLKYGIGLESHFDTP NIPYVRGSLDTLAQAKVPIWLTEIDVKKGPKQVEYLEEVMREGFAHPGVKGIVLWGAWHAKECYVM |
| 8 | M.759 | 87 | YSANIECEKEPPKPLYGGGILTGAEAPAPVSAGGK KLLMAKSKSAPAKGSTLKVELEKDTHYTLSAWLQLSKSTGDVKAILVTPDGNFNTAGMLVVQSGCWTMLKGGATSFAAGKGELFFET NVTAELVDSMSLQPFSFEEWKSRHESIAKERKKKKVKITVHGSDGKVLPDAELSLERVAKGFPLGNAMTKEILDIPEYEKWFTSRFT VATMENEMKWYSTEYDQNQELYEIPDKMLALAEKYNISVRGHNVFWDDQSKQMDWVSKLSAPQLKKAMEKRMKNVVSRYAGKLIHWD VLNENLHYSFFEDKLGKDASAEVFKEVAKLDDKPILFMNEYNTIEEPNDAAPLPTKYLAKLKQIQSYPGNSKLKYGIGLESHFDTPN IPYVRGSLDTLAQAKVPIWLTEIDVKKGPKQVEYLEEVMREGFAHPGVKGIVLWGAWHAKECYVMCLTDKNFKNLPVGDVVDKLITE WKAVPEDAKTDDKGVFEAELFHGEYNVTVKHKSLKEPLMHTVDLDSKSEATIRAKK |
| 8 | M.765 | 88 | ...HTTIVASGIENMKIFTRTWVLLLLLVLLFEGCLAKSYKSEKSDKSATYDYSANIECEKEPPKPLYGGGILTGAEAPAPVSAGGK KLLMAKSKSAPAKGSTLKVELEKDTHYTLSAWLQLSKSTGDVKAILVTPDGNFNTAGMLVVQSGCWTMLKGGATSFAAGKGELFFET NVTAELVDSMSLQPFSFEEWKSRHESIAKERKKKKVKITVHGSDGKVLPDAELSLERVAKGFPLGNAMTKEILDIPEYEKWFTSRFT VATMENEMKWYSTEYDQNQELYEIPDKMLALAEKYNISVRGHNVFWDDQSKQMDWVSKLSAPQLKKAMEKRMKNVVSRYAGKLIHWD VLNENLHYSFFEDKLGKDASAEVFKEVAKLDDKPILFMNEYNTIEEPNDAAPLPTKYLAKLKQIQSYPGNSKLKYGIGLESHFDTPN IPYVRGSLDTLAQAKVPIWLTEIDVKKGPKQVEYLEEVMREGFAHPGVKGIVLWGAWHAKECYVMCLTDKNFKNLPVGDVVDKLITE WKAVPEDAKTDDKGVFEAELFHGEYNVTVKHKSLKEPLMHTVDLDSKSEATIRAKK |
| 8 | M.747 | 89 | ....LMVDSMSLQPFSFEEWKSHRHESIAKERKKKKVKITVHGSDGKVLPDAELSLERVAKGFPLGNAMTKEILDIPEYEKWFTSRF TVATMENEMKWYSTEYDQNQELYEIPDKMLALAEKYNISVRGHNVFWDDQSKQMDWVSKLSAPQLKKAMEKRMKNVVSRYAGKLIHW DVLNENLHYSFFEDKLGKDASAEVFKEVAKLDDKPILFMNEYNTIEEPNDAAPLPTKYLAKLKQISYPGNSKLKYGIGLESHFDTP NIPYVRGSLDTLAQAKVPIWLTEIDVKKGPKQVEYLEEVMREGFAHPGVKGIVLWGAWHAKECYVMCLTDKNFKNLPVGDVVDKLIT EWKAVPEDAKTDDKGVFEAELFHGEYNVTVKHKSLKEPLMHTVDLLDSKSEATIRAKK |
| 8 | M.763 | 90 | ALTHTTIVASGIENMKIFTRTWVLLLLLVLLFEGCLAKSYKSEKSDKSATYDYSANIECEKEPPKPLYGGGILTGAEAPAPVSAGGK KLLMAKSKSAPAKGSTLKVELEKDTHYTLSAWLQLSKSTGDVKAILVTPDGNFNTAGMLVVQSGCWTMLKGGATSFAAGKGELFFET NVTAELMVDSMSLQPFSFEEWKSHRHESIAKERKKKKVKITVHGSDGKVLPDAELSLERVAKGFPLGNAMTKEILDIPEYEKWFTSRF TVATMENEMKWYSTEYDQNQELYEIPDKMLALAEKYNISVRGHNVFWDDQSKQMDWVSKLSAPQLKKAMEKRMKNVVSRYAGKLIHW DVLNENLHYSFFEDKLGKDASAEVFKEVAKLDDKPILFMNEYNTIEEPNDAAPLPTKYLAKLKQISYPGNSKLKYGIGLESHFDTP NIPYVRGSLDTLAQAKVPIWLTEIDVKKGPKQVEYLEEVMREGFAHPGVKGIVLWGAWHAKECYVMCLTDKNFKNLPVGDVVDKLIT EWKAVPEDAKTDDKGVFEAELFHGEYNVTVKHKSLKEPLMHTVDLLDSKSEATIRAKK |
| 8 | M.733 | 91 | ........SKSAPAKGSTLKVELEKDTHYTLSAWLQLSKSTGDVKAILVTPDGNFNTAGMLVVQSGCWTMLKGGATSFAAGKGELFFET NVTAELMVDSMSLQPFSFEEWKSHRHESIAKERKKKKVKITVHGSDGKVLPDAELSLERVAKGFPLGNAMTKEILDIPEYEKWFTSRF TVATMENEMKWYSTEYDQNQELYEIPDKMLALAEKYNISVRGHNVFWDDQSKQMDWVSKLSAPQLKKAMEKRMKNVVSRYAGKLIHW DVLNENLHYSFFEDKLGKDASAEVFKEVAKLDDKPILFMNEYNTIEEPNDAAPLPTKYLAKLKQISYPGNSKLKYGIGLESHFDTP NIPYVRGSLDTLAQAKVPIWLTEIDVKKGPKQVEYLEEVMREGFAHPGVKGIVLWGAWHAKECYVMCLTDKNFKNLPVGDVVDKLIT EWKAVPEDAKTDDKGVFEAELFHGEYNVTVKHKSLKEPLMHTVDLLDSKSEATIRAKK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 9 | M.651 | 92 | .................VSADKTAKVWDIMEDASGKVNRTLVCTGIGGVDDMLVGCLWQNDHLVTVSLGGTFNVFSASNPDKEPVSF AGHLKTVSSLLTYFPQSNPRTMLSTSYDGVIIRWIQGVGYGGRLIRKNNTQIKCFVAAEEELITSGYDNMVFRIPLNGDQCGDAESVD VGGQPNALNIAVQQPEFALITTDSAIVLLHKSTVTSSAVSPDGTEAIVGAQDGKLRIYSISGDTLTEEAVLERHRGA ITSIHYSPDVSMFASADANREAVAWDRATREIKLKNMLFHTARINCLAWSPDSRLVATGSIDTCAIIYDVDKPASSRITIKGAHLGG VHGLTFADNDTLVTAGEDACVRWKLVVP |
| 9 | M.677 | 93 | .................VLTVSADKTAKVWDIMEDASGKVNRTLVCTGIGGVDDMLVGCLWQNDHLVTVSLGGTFNVFSASNPDKEPVSF AGHLKTVSSLLTYFPQSNPRTMLSTSYDGVIIRWIQGVGYGGRLIRKNNTQIKCFVAAEEELITSGYDNMVFRIPLNGDQCGDAESVD VGGQPNALNIAVQQPEFALITTDSAIVLLHKSTVTSTTKVSYTITSSAVSPDGTEAIVGAQDGKLRIYSISGDTLTEEAVLERHRGA ITSIHYSPDVSMFASADANREAVAWDRATREIKLKNMLFHTARINCLAWSPDSRLVATGSIDTCAIIYDVDKPASSRITIKGAHLGG VHGLTFADNDTLVTAGEDACVRWKLVVPQ |
| 9 | M.597 | 94 | .................LTVSADKTAKVWDIMEDASGKVNRTLVCTGIGGVDDMLVGCLWQNDHLVTVSLGGTFNVFSASNPDKEPVSF AGHLKTVSSLLTYFPQSNPRTMLSTSYDGVIIRWIQGVGYGGRLIRKNNTQIKCFVAAEEELITSGYDNMVFRIPLNGDQCGDAESVD VGGQPNALNIAVQQPEFALITTDSAIVLLHKSTVTSTTKVSYTITSSAVSPDGTEAIVGAQDGKLRIYSISGDTLTEEAVLERHRGA ITSIHYSPDVSMFASADANREAVAWDRATREIKLKNMLFHTARINCLAWSPDSRLVATGSIDTCAI |
| 9 | M.547 | 95 | .................RGGRERERRPKMAQLQETYACSPATERGRGILLGGDAKTDTIVYCAGRTFFFRRLDAPLDAWTYTEHAYP TTVARISPNGEWVASADVSGCVRWGRNGDRALKAEFRPISGRVDDLRWSPDGLRIVVSGDGKGKSLVRAFMWDSGSTVGDFDGHSK RVLSCDFKPTRPFRIVTCGEDFLANYYEGPPFFKFKHSIRDHSNFVNCIRYSPDGSKFITVSSDKRGLIYDGKTGDKIGELSSEDSHT GSIYAVSWSADSKQVLTVSAD |
| 9 | M.761 | 96 | .................TLPDQSEEGERRRPKMAQLQETYACSPATERGRGILLGGDAKTDTIVYCAGRTFFFRRLDAPLDAWTYTEHAYP TTVARISPNGEWVASADVSGCVRWGRNGDRALKAEFRPISGRVDDLRWSPDGLRIVVSGDGKGKSLVRAFMWDSGSTVGDFDGHSK RVLSCDFKPTRPFRIVTCGEDFLANYYEGPPFFKFKHSIRDHSNFVNCIRYSPDGSKFITVSSDKRGLIYDGKTGDKIGELSSEDSHT GSIYAVSWSADSKQVLTVSAD |
| 9 | M.571 | 97 | .................GITTLHSHPTRGPTLPDQSEEGERRRPKMAQLQETYACSPATERGRGILLGGDAKTDTIVYCAGRTVFFRRLDAPLDAWTYTEHAYP TTVARISPNGEWVASADVSGCVRWGRNGDRALKAEFRPISGRVDDLRWSPDGLRIVVSGDGKGKSLVRAFMWDSGSTVGDFDGHSK RVLSCDFKPTRPFRIVTCGEDFLANYYEGPPFFKFKHSIRDHSNFVNCIRYSPDGSKFITVSSDKRGLIYDGKTGDKIGELSSEDSHT GSIYAVSWSADSKQVLTVSAD |
| 9 | M.562 | 98 | .................GITTLHSHPTRGPTLPDQSEEGERRRPKMAQLQETYACSPATERGRGILLGGDAKTDTIVYCAGRTVFFRRLDAPLDAWTYTEHAYP TTVARISPNGEWVASADVSGCVRWGRNGDRALKAEFRPISGRVDDLRWSPDGLRIVVSGDGKGKSLVRAFMWDSGSTVGDFDGHSK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 9 | M.657 | 99 | RVLSCDFKPTRPFRIVTCGEDFLANYYEGPPFKFKHSIRDHSNFVNCIRYSPDGKFITVSSDKRGLIYDGKTGDKIGELSSEDSHT<br>GSIYAVSWSADSKQ |
| 9 | M.738 | 100 | .....SWSADSKQVLTVSSLLTYFPQSNPRTMLSTSYDGVIIRWIQGVGYGGRLIRKNNTQIKCFVAAEEELITSGYDNMVFRIPLNGDQCGDAESVD<br>AGHLKTVSSLLTYFPQSNPRTMLSTSYDGVIIRWIQGVGYGGRLIRKNNTQIKCFVAAEEELITSGYDNMVFRIPLNGDQCGDAESVD<br>VGGQPNALNIAVQQPEFALITTDSAIVLLHKSTVTSSAVSPDGTEAIVGAQDGKLRIYSISGDTLTEEAVLERHRGA<br>ITSIHYSPDVSMFASADANREAVAWDRATREIKLKNMLFHTARINCLAWSPDSRLVATGSIDTCAIIYDVDKPASSRITIKGAHLGG<br>VHGLTFADNDTLVTAGEDACVRVW |
| 9 | M.734 | 101 | .....SSAPWAAVVIQKFILSCSFIPGIQSYAKFSEMCRWDSGSTVGDFDGHSK<br>RVLSCDFKPTRPFRIVTCGEDFLANYYEGPPFKFKHSIRDHSNFVNCIRYSPDGSKFITVSSDKRGLIYDGKTGDKIGELSSEDSHT<br>GSIYAVSWSADSKQVLTVSSLLTYFPQSNPRTMLSTSYDGVIIRWIQGVGYGGRLIRKNNTQIKCFVAAEEELITSGYDNMVFRIPLNGDQCGDAESVD<br>AGHLKTVSSLLTYFPQSNPRTMLSTSYDGVIIRWIQGVGYGGRLIRKNNTQIKCFVAAEEELITSGYDNMVFRIPLNGDQCGDAESVD<br>VGGQPNALNIAVQQPEFALITTDSAIVLLHKSTVTSSAVSPDGTEAIVGAQDGKLRIYSISGDTLTEEAVLERHRGA<br>ITSIHYSPDVSMFASADANREAVAWDRATREIKLKNMLFHTARINCLAWSPDSRLVATGSIDTCAIIYDVDKPASSRITIKGAHLGG<br>VHGLTFADNDTLVTAGEDACVRVWKLVVP |
| 9 | M.621 | 102 | .....GSSAPWAAVVIQKFILSCSFIPGIQSYAKFSEMCRWDSGSTVGDFDGHSK<br>RVLSCDFKPTRPFRIVTCGEDFLANYYEGPPFKFKHSIRDHSNFVNCIRYSPDGSKFITVSSDKRGLIYDGKTGDKIGELSSEDSHT<br>GSIYAVSWSADSKQVLTVSSLLTYFPQSNPRTMLSTSYDGVIIRWIQGVGYGGRLIRKNNTQIKCFVAAEEELITSGYDNMVFRIPLNGDQCGDAESVD<br>AGHLKTVSSLLTYFPQSNPRTMLSTSYDGVIIRWIQGVGYGGRLIRKNNTQIKCFVAAEEELITSGYDNMVFRIPLNGDQCGDAESVD<br>VGGQPNALNIAVQQPEFALITTDSAIVLLHKSTVTSSAVSPDGTEAIVGAQDGKLRIYSISGDTLTEEAVLERHRGA<br>ITSIHYSPDVSMFASADANREAVAWDRATREIKLKNMLFHTARINCLAWSPDSRLVATGSIDTCAIIYDVDKPASSRITIKGAHLGG<br>VHGLTFADNDTLVTAGEDACVRVW |
| 9 | M.741 | 103 | .....CTGIGGVDDMLVGCLWQNDHLVTSGVDDMLVGCLWQNDHLVTSGVDDMLVGCLWQNDHLVTSGVDDMLVGCLWQNDHLVTSGYDNMVFRIPLNGDQCGDAESVD<br>AGHLKTVSSLLTYFPQSNPRTMLSTSYDGVIIRWIQGVGYGGRLIRKNNTQIKCFVAAEEELITSGYDNMVFRIPLNGDQCGDAESVD<br>VGGQPNALNIAVQQPEFALITTDSAIVLLHKSTVTSSAVSPDGTEAIVGAQDGKLRIYSISGDTLTEEAVLERHRGA<br>ITSIHYSPDVSMFASADANREAVAWDRATREIKLKNMLFHTARINCLAWSPDSRLVATGSIDTCAIIYDVDKPASSRITIKGAHLGG<br>VHGLTFADNDTLVTAGEDACVRVWKLVVP |
| 9 | | | .....CVRVWGRNGDRALKAEFRPISGRVDDLRWSPDGLRIVVSGDGKGKSLVRAPMWDSGSTVGDFDGHSK<br>RVLSCDFKPTRPFRIVTCGEDFLANYYEGPPFKFKHSIRDHSNFVNCIRYSPDGSKFITVSSDKRGLIYDGKTGDKIGELSSEDSHT<br>GSIYAVSWSADSKQVLTVSSLLTYFPQSNPRTMLSTSYDGVIIRWIQGVGYGGRLIRKNNTQIKCFVAAEEELITSGYDNMVFRIPLNGDQCGDAESVD<br>AGHLKTVSSLLTYFPQSNPRTMLSTSYDGVIIRWIQGVGYGGRLIRKNNTQIKCFVAAEEELITSGYDNMVFRIPLNGDQCGDAESVD<br>VGGQPNALNIAVQQPEFALITTDSAIVLLHKSTVTSSAVSPDGTEAIVGAQDGKLRIYSISGDTLTEEAVLERHRGA<br>ITSIHYSPDVSMFASADANREAVAWDRATREIKLKNMLFHTARINCLAWSPDSRLVATGSIDTCAIIYDVDKPASSRITIKGAHLGG<br>VHGLTFADNDTLVTAGEDACVRVWKLVVP |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 10 | M.177 | 104 | GATIVVSGDGRYFSKDAVQIITKMAAANGVRRVWVGQDSLLSTPAVSAIIRERIAADGSKATGAFILTASH |
| 11 | M.579 | 105 | .........................RLDQVQLLVKGASERGAKRIRLHILADGRDVLDGSSVGFVETLENDLAQLREKGVDAQVASGGGR<br>MYVTMDRYENDWDVVKRGWDAQVLGEAPYKFKSALEAVKTLRAEPKANDQYLPAFVIVDGSKSVGPIVDGDAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGKFDQVRINLPN |
| 11 | M.513 | 106 | .ESFAEGTLHLIGLLSDGGVHSRLDQVQLLVKGASERGAKRIRLHILADGRDVLDGSSVGFVETLENDLAQLREKGVDAQVASGGGR<br>MYVTMDRYENDWDVVKRGWDAQVLGEAPYKFKSALEAVKTLRAEPKANDQYLPAFVIVDGSKSVGPIVDGDAVVTFNFRADRMVML<br>AKALEFADFDKFPDRVRPKIIKYAGMLQYDGELKLPNKFLVSPPLIERTSGEYLVKNGVR |
| 11 | M.446 | 107 | ..................................RDVLDGSSVGFVETLENDLAQLREKGVDAQVASGGGR<br>MYVTMDRYENDWDVVKRGWDAQVLGEAPYKFKSALEAVKTLRAEPKANDQYLPAFVIVDGSKSVGPIVDGDAVVTFNFRADRMVML<br>AKALEFADFDKFPDRVRPKIIKYAGMLQYDGELKLPNKFLVSPPLIERTSGEYLVKNGVRT |
| 11 | M.388 | 108 | ...........................................................................DAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGKFDQVRINLP |
| 11 | M.391 | 109 | ...........................................................................DAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGKFDQVRINLPN |
| 11 | M.593 | 110 | .......ESENVKEFSYINLFLVSLYFQLLYDQVLLVKGASERGAKRIRLHILTDGRDVLDGSSVGFVETLENDLAQLREKGVDAQVASGGGR<br>MYVTMDRYENDWDVVKRGWDAQVLGEAPYKFKSALEAVKTLRAEPKANDQYLPAFVIVDGSKSVGPIVDGDAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGKFDQVRINLPN |
| 11 | M.506 | 111 | ..............................................................................VTSGGGR<br>MYVTMDRYENDWDVVKRGWDAQVLGEAPYKFKSALEAVKTLRAEPKANDQYLPAFVIVDGSKSVGPIVDGDAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGKFDQVRINLPN |
| 11 | M.395 | 112 | .........................................................................................GR<br>MYVTMDRYENDWDVVKRGWDAQVLGEAPYKFKSALEAVKTLRAEPKANDQYLPAFVIVDGSKSVGPIVDGDAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGKFDQVRINLPN — note truncated as TFAC |
| 11 | M.381 | 113 | ...........................................................................DAVVTFNFRADRMVML<br>AKALEFADFDKFPDRVRPKIIKYAGMLQYDGELKLPNKFLVSPPLIERTSGEYLVKNGVRTFACSETVKFGHVTFFWNGNRSGYFDET<br>KEEYIEIPSDSGITFNEQPKMKALEIAEKTRDAILSGK |
| 11 | M.372 | 114 | KESFAEGTLHLIGLLSDGGVHSRLDQVQLLVKGASERGAKRIRLHILTDGRDVLDGSSVGFVETLENDLAQLREKGVDAQVASGGGR<br>MYVTMDRYENDWDVVKRGWDAQVLGEAPYKFKSALEAVKTLRAEP |
| 12 | M.619 | 115 | CSSDYKLLCSSFPVIPYHQGRNGNLSALACPLNQKKK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 12 | M.656 | 116 | CSSDYKLLCSSFPVITYHQGRNGNLSALACPLNQKKKKKK |
| 12 | M.525 | 117 | CSSDYKLLCSSFPVITYHQGRNGNLSALACPLNQKKKKKK |
| 13 | M.698 | 118 | ...AMDEEYDVIVLGTFLKECILSGLLSVDGLKVLHMDRNDYYGGESTSLNLTKIWKRFKGSEATPDHLGVSKEYNVDMVPKFMMA NGALVRVLIRTSVTKYLNFKAVDGSFYNNGKIHKVPATDVEAIKSNLMGLFEKRRARKFFIYVQDYEEEDPKSHEGLDLHKVTTRE VISKYGLEDDTVDFIGHALALHRDDNVLDEPAIDTVKRMKLYAESLARFQGGSPYIYPLYGLGELPQAFARLSAVVGGTYMLNKPEC KVEFDESGKAFGVTSEGETACKCKKVVCDPSYLPDKVTKVGRVARAICIMKHPIPDTKDSHSVQIILPKKQLKRKSDMYVFCCSYAHN VAPKGKFIAFVSTEAETDKPEIELKPGIDLLGPVEETFFDIYDRYEPANAPEEDNCFVTNSYDATTH |
| 13 | M.699 | 119 | ...AMDEEYDVIVLGTFLKECILSGLLSVDGLKVLHMDRNDYYGGESTSLNLTKIWKRFKGSEATPDHLGVSKEYNVDMVPKFMMA NGALVRVLIRTSVTKYLNFKAVDGSFYNNGKIHKVPATDVEAIKSNLMGLFEKRRARKFFIYVQDYEEEDPKSHEGLDLHKVTTRE VISKYGLEDDTVDFIGHALALHRDDNVLDEPAIDTVKRMKLYAESLARFQGGSPYIYPLYGLGELPQAFARLSAVVGGTYMLNKPEC KVEFDESGKAFGVTSEGETACKCKKVVCDPSYLPDKVTKVGRVARAICIMKHPIPDTKDSHSVQIILPKKQLKRKSDMYVFCCSYAHN VAPKGKFIAFVSTEAETDKPEIELKPGIDLLGPVEETFFDIYDRYEPANAPEEDNCFVTNSYDATTH |
| 13 | M.439 | 120 | ......................................................................TTRE VISKYGLEDDTVDFIGHALALHRDDNVLDEPAIDTVKRMKLYAESLARFQGGSPYIYPLYGLGELPQAFARLSAVVGGTYMLNKPEC KVEFDESGKAFGVTSEGETACKCKKVVCDPSYLPDKVTKVGRVARAICIMKHPIPDTKDSHSVQIILPKKQLKRKSDMYVFCCSY |
| 13 | M.630 | 121 | ...AMDEEYDVIVLGTFLKECILSGLLSVDGLKVLHMDRNDYYGGESTSLNLTKIWKRFKGSEATPDHLGVSKEYNVDMVPKFMMA NGALVRVLIRTSVTKYLNFKAVDGSFYNNGKIHKVPATDVEAIKSNLMGLFEKRRARKFFIYVQDYEEEDPKSHEGLDLHKVTTRE VISKYGLEDDTVDFIGHALALHRDDNVLDEPAIDTVKRMKLYAESLARFQGGSPYIYPLYGLGELPQAFARLSAVVGGTYMLNKPEC KVEFDESGKAFGVTSEGETACKCKKVVCDPSYLPDKVTKVGRVARAICIMKHPIPDTKDSHSVQIILPKKQLKRKSDMYVFCCSYA |
| 13 | M.708 | 122 | ...LLSVDGLKVLHMDRNDYYGGESTSLNLTKIWKRFKGSEATPDHLGVSKEYNVDMVPKFMMA NGALVRVLIRTSVTKYLNFKAVDGSFYNNGKIHKVPATDVEAIKSNLMGLFEKRRARKFFIYVQDYEEEDPKSHEGLDLHKVTTRE VISKYGLEDDTVDFIGHALALHRDDNVLDEPAIDTVKRMKLYAESLARFQGGSPYIYPLYGLGELPQAFARLSAVVGGTYMLNKPEC KVEFDESGKAFGVTSEGETACKCKKVVCDPSYLPDKVTKVGRVARAICIMKHPIPDTKDSHSVQIILPKKQLKRKSDMYVFCCSYA VAPKGKFIAFVSTEAETDKPEIELKPGIDLLGPVEETFFDIYDRYEPANAPEEDNCFVTNSYDATTHFETVKDVLALYSKITGKEL DLSVDLNAASAGESEAA |
| 13 | M.620 | 123 | ...MDEEYDVIVLGTFLKECILSGLLSVDGLKVLHMDRNDYYGGESTSLNLTKIWKRFKGSEATPDHLGVSKEYNVDMVPKFMMA NGALVRVLIRTSVTKYLNFKAVDGSFYNNGKIHKVPATDVEAIKSNLMGLFEKRRARKFFIYVQDYEEEDPKSHEGLDLHKVTTRE VISKYGLEDDTVDFIGHALALHRDDNVLDEPAIDTVKRMKLYAESLARFQGGSPYIYPLYGLGELPQAFARLSAVVGGTYMLNKPEC KVEFDESGKAFGVTSEGETACKCKKVVCDPSYLPDKVTKVGRVARAICIMKHPIPDTKDSHSVQIILPKKQ |
| 14 | M.758 | 124 | LLGYLLMVVAIRRPRPVRCFSLRAW |
| 14 | M.764 | 125 | LLGYLLMVVAIRRPRPVRCFSLRAW |
| 14 | M.746 | 126 | LLGYLLMVVAIRRPRPVRCFSLRAW |
| 14 | M.762 | 127 | LLGYLLMVVAIRRPRPVRCFSLRAW |
| 15 | M.716 | 128 | PRVNFFKRYNLTCVFW |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 15 | M.726 | 129 | PRVNFFKRYNLTCVFWSKKKKKNSS |
| 16 | MN.66 | 130 | RSDEKLLSVFRREGVVYGAGIGPGVYDIHSPRIPSKEIADDFALFRGTRPPRRPKRPRTLQRQIDSLCPGFCLADVTPETYRIEER |
| 17 | M.717 | 131 | NVCTRLSPFCCLYCILCCWYSMRLVTVM |
| 17 | M.727 | 132 | NVCTRLSPFCCLYCILCCWYSMRLVTVM |
| 17 | M.719 | 133 | NVCTRLSPFCCLYCILCCWYSMRLVTVM |
| 17 | M.724 | 134 | NVCTRLSPFCCLYCILCCWYSMRLVTVM |
| 17 | M.577 | 135 | NVCTRLSPFCCLYCILCCWYSMRLVTVM |
| 18 | M.8 | 136 | NIPATWGAMEKLYDAGKARAIGVSNLASKKLGDLLAVARIPPA |
| 19 | M.235 | 137 | DVNHATVKTSSGEKPVRELVQDDEWLNGPFIATVQQRGAAIIKARKLSSALSAASSACDHIRDWVLGTPEGTFVSMGVYSD |
| 20 | M.678 | 138 | LKTEESRPSKPNRIERRKREEHAPPGQHIAMAASSRRASQLLGSAASRFLHSRGYAAAAAPSPAVFVDKSTRVICQGITGKNGT FHTEQAIEYGTNMVGGVTPKKGGTEHLGLPVFNSVAEAKAETKANASVIVPPPFAAAAIMEALEAELDLVVCITEGIPQHDMVKVK AALNRQSKTRLIGPNCPGIIKPGECKIGIMPGYIHKPGRIGIVSRSGTLTYEAVFQTTAVGLGQSTCVGMGGDPFNGTNFVDCLEKF VADPQTEGIVLIGEIGGTAEBDAAAFIQASKTDKPVVAFIAGLTAPPGRRMGHAGAIVSGGKGTAQDKIKALREAGVTVVESPAKIG STMFEIFKQRGMVE |
| 20 | M.675 | 139 | .......SRPSPKPNRIERRKREEHAPPGQHIAMAASSRRASQLLGSAASRFLHSRGYAAAAAPSPAVFVDKSTRVICQGITGKNGT FHTEQAIEYGTNMVGGVTPKKGGTEHLGLPVFNSVAEAKAETKANASVIVPPPFAAAAIMEALEAELDLVVCITEGIPQHDMVKVK AALNRQSKTRLIGPNCPGIIKPGECKIGIMPGYIHKPGRIGIVSRSGTLTYEAVFQTTAVGLGQSTCVGMGGDPFNGTNFVDCLEKF VADPQTEGIVLIGEIGGTAEBDAAAFIQASKTDKPVVAFIAGLTAPPGRRMGHAGAIVSGGKGTAQDKIKALREAGVTVVESPAKIG STMFEIFKQRGMVE |
| 20 | M.641 | 140 | ......................AAAPSPAVFVDKSTRVICQGITGKNGT FHTEQAIEYGTNMVGGVTPKKGGTEHLGLPVFNSVAEAKAETKANASVIVPPPFAAAAIMEALEAELDLVVCITEGIPQHDMVKVK AALNRQSKTRLIGPNCPGIIKPGECKIGIMPGYIHKPGRIGIVSRSGTLTYEAVFQTTAVGLGQSTCVGMGGDPFNGTNFVDCLEKF VADPQTEGIVLIGEIGGTAEBDAAAFIQASKTDKPVVAFIAGLTAPPGRRMGHAGAIVSGGKGTAQDKIKALREAGVTVVESPAKIG STMFEIFKQRGMVE |
| 20 | M.499 | 141 | .................................MPGYIHKPGRIGIVSRSGTLTYEAVFQTTAVGLGQSTCVGMGGDPFNGTNFVDCLEKF VADPQTEGIVLIGEIGGTAEBDAAAFIQASKTDKPVVAFIAGLTAPPGRRMGHAGAIVSGGKGTAQDKIKALREAGVTVVESPAKIG STMFEIFKQRGMVE |
| 20 | M.583 | 142 | .......QQVGVGVTPKKGGTEHLGLPVFNSVAEAKAETKANASVIVPPPFAAAAIMEALEAELDLVVCITEGIPQHDMVKVK AALNRQSKTRLIGPNCPGIIKPGECKIGIMPGYIHKPGRIGIVSRSGTLTYEAVFQTTAVGLGQSTCVGMGGDPFNGTNFVDCLEKF VADPQTEGIVLIGEIGGTAEBDAAAFIQASKTDKPVVAFIAGLTAPPGRRMGHAGAIVSGGKGTAQDKIKALREAGVTVVESPAKIG STMFEIFKQRGMVE |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 20 | M.649 | 143 | ....EVLTSKRQQVGGVTPKKGGTEHLGLPVFNSVAEAKAETKANASVIYPPPFAAAAIMEALEALDLVVCITEGIPQHDMVVK AALNRQSKTRLIGPNCPGIIKPGECKIGIMPGYIHKPGRIGIVSRSGTLTYEAVFQTTAVGLGQSTCVGMGGDPFNGTNFVDCLEKF VADPQTEGIVLIGEIGTAEBDAAAFIQASKTDKPVVAFIAGLTAPPGRRMGHAGAIVSGGKGTAQDKIKALREAGVTVVESPAKIG STMFEIFKQRGMVE |
| 21 | M.6 | 144 | ................LRVQSDQAVFYQCYFDGYQDTLYTHAQRQFFRDCTVTGTIDFI |
| 21 | M.29 | 145 | DGSGDFKTIKEALAKVPPKSASMYVMYIKEGTYKEYVTVPRTVTNLVMIGDG |
| 21 | M.34 | 146 | ................VALRVQSDQAVFYQCYFDGYQDTLYTHAQRQFFRDCTVTGTIDFIFWITTWEL |
| 21 | M.183 | 147 | ................LRVQSDQAVFYQCYFDGYQDTLYTHAQRQFFRDCTVTGTIDFIFGNSQVVIQN.................MKD |
| 21 | M.101 | 148 | IRVENTAGADNHQAVALRVQSDQAVFYQCYFDGYQDTLYTHAQRQFFRDCTVTGTIDFIF.................MKD |
| 21 | M.149 | 149 | ................LAKVPPKSASMYVMYIKEGTYKEYVTVPRTVTNLVMIGDGAAKTIITGNKNFKMNLTSMVAVS |
| 21 | M.164 | 150 | ................LAKVPPKSASMYVMYIKEGTYKEYVTVPRTVTNLVMIGDGAAKTIITGNKNFKMNLT |
| 21 | M.129 | 151 | ................LAKVPPKSASMYVMYIKEGTYKEYVTVPRTVTNLVMIGDGAAKTIITGNKNFKMNLT |
| 21 | M.45 | 152 | IRVENTAGADNHQAVALRVQSDQAVFYQCYFDGAVTEEL.................DTATMEAIGNGFFMKD |
| 21 | M.116 | 153 | IRVENTAGADNHQAVALRVQSDQAVFYQCYFDGYQDTLYTHAQRQFFRDCTV.................TKDTATMEAIGNGFFMKD |
| 21 | M.165 | 154 | IRVENTAGADNHQAVALRVQSDQAVFYQCYFDGYQDTLYTHAQRQFFRDCTV.................DTATMEAIGNGFFMKD |
| 21 | M.146 | 155 | IRVENTAGADNHQAVALRVQSDQAVFYQCYFDGYQDTLYTLMSFMKNP.................EAIGNGFFMKD |
| 21 | M.69 | 156 | ................AKVPPKSASMYVMYIKEGTYKEYVTVPRTVTNLVMIGDGAAKTIITGNKNFKMNLTSMVAVSLV |
| 21 | M.123 | 157 | ................AKVPPKSASMYVMYIKEGTYKEYVTVPRTVTNLVMIGDGAAKTIITGNKNFKMNLTTDKTATM |
| 21 | M.107 | 158 | ................AKVPPKSASMYVMYIKEGTYKEYVTVPRTVTNLVMIGDGAAKTIITGNKNFKMNLTTDKTATM |
| 21 | M.3 | 159 | ................KSASMYVMYIKEGTYKEYVTVPRTVTNLVMIGDGATKTIIT |
| 21 | M.113 | 160 | ................VPPKSASMYVMYIKEGTYKEYVTVPRTVTNLVMIGDGAAKTIITGNKNFKMNL |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 21 | M.204 | 161 | IRVENTAGADNHQAVALRVQSDQAVFYQCYFDGYQDTLYTHAQRQFFRDCTVTGTIDFI..............DTATMEAIGNGFFMKD |
| 21 | M.174 | 162 | ..........SASMYVMIKEGTYKEYVTVPRTVTNLVMIGDGAAKTIITGNKNFKMNLTTKDTATMEAIGNGFFMKD IRV |
| 21 | M.178 | 163 | ..GSGDFKTIKEALAKVPPKSASMVYMYIKEGTYKEYVTVPRTVTNLVMIGDGAAKTIILKFLLPVMIVLAAP |
| 21 | M.191 | 164 | .GSGDFKTIKEALAKVPPKSASMYVMYIKEGTYKEYVTVPRTVTNLVMIGDGAAKTIITGNKNFKMNLTTKDTA |
| 22 | M.580 | 165 | ..............PALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.587 | 166 | ..............PAPPPTQHLPSPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.594 | 167 | VLLLRRTPPRSSSYPTVASPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.539 | 168 | ..............APPPTQQQPSPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.569 | 169 | ..............MPSPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.588 | 170 | PPAPPPTQQQPSPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.615 | 171 | APTSASTGSPNSDSNTRVLLLRRTSPFSAPPPTQQLPSPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |
| 22 | M.578 | 172 | ..............PSPPALVPMALPNQTVDYPSFKLVIVGDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAAQPLPDDDD DLVE |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 22 | M.352 | 173 | ................NQGTVDYPSFKLVIVDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCG |
| 22 | M.514 | 174 | ................NQGTVDYPSFKLVIVDGGTGKTTFVKRHLTGEFEKKYE PTIGVEVHPLDFTTNCGKIRFYCWDTAGQEKFGGLRDGYYIHGQCAIIMFDVTSRLTYKNVPTWHRDLCRVCENIPIVLCGNKVDVK NRQVKAKQVTFHRKKNLQYYEISAKSNYNFEKPFLYLARKLAGDANIHFVEAVALKPPEVTFDLAMQQQHEAELAAAAQPLPDDD DLVE |
| 23 | M.419 | 175 | RTSSWGSGASLKIDRRELVTTRIYGFL |
| 23 | M.443 | 176 | RTSSWGSGASLKIDRRELVTTRIYGFL |
| 24 | M.540 | 177 | ..LVQRSRRFPDLRFLHAAVAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFT |
| 24 | M.640 | 178 | ........SRSPPIRSRPLHAAVAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGG |
| 24 | M.642 | 179 | ........SRSPPIRSRPLHAAVAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGT |
| 24 | M.646 | 180 | ........RPDRRRFPDLGFLHAAVAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGT |
| 24 | M.627 | 181 | ...............LHAAVAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV NDAFGTAHRAHASTEGVTKFLRPSVAGFLMQKELDYLVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGT |
| 24 | M.626 | 182 | ...............AMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV NDAFGTAHRAHASTEGVTKFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGT |
| 24 | M.645 | 183 | ..SLSLSLLSRPDRRRFDLGFLHAAVAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLLENVRFYKEEEKNDPEFAKKLASVADLYV |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 24 | M.652 | 184 | NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFE |
| 24 | M.650 | 185 | .........LPRPDRRRFDPGFSTQQAAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAA |
| 24 | M.599 | 186 | .........LPRPDRRRFDPGFSTQQAAMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAA |
| 24 | M.622 | 187 | ........FQQRPKGVTPKFSLKPLVPRLSELLGVEVVMANDCIGEEVEKLAAALPEGGVLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGT |
| 24 | M.565 | 188 | .........AMATKRSVGTLGEADLKGKKVFLRADLNVPLDDAQKITDDTRIRASIPTIKFLLEKGAKV ILASHLGRPKGVTPKFSLKPLVPRLSELLGVEVVMANDCIGEEVEKLAAALPEGGVLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAG |
| 24 | M.567 | 189 | .........................................................................V ILASHLGRPKGVTPKFSLKPLVPRLSELLGVEVVMANDCIGEEVEKLAAALPEGGVLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKTVIW NGPMGVFEFEKFAAGT |
| 24 | M.581 | 190 | .........................................................................V .........................LDDAQKITDDTRIRASIPTIKFLLEKGAKV ILASHLGRPKGVTPKFSLKPLVPRLSELLGVEVVMANDCIGEEVEKLAAALPEGGVLLENVRFYKEEEKNDPEFAKKLASVADLYV NDAFGTAHRAHASTEGVTKFLRPSVAGFLMQKELDYLVGAVANPKKPFAAIVGGSKVSSKIGVIESLLAKVDILILGGGMIFTFYKA QGKAVGNSLVEEDKLELATSLIETAKAKGVSLLLPTDVVVADKFAPDAESKTVPADAIPDGWMGLDVGPDSIKTFSEALDTTKT |
| 25 | M.609 | 191 | KSAPALRILRSFPSHS |
| 26 | M.182 | 192 | ......................................... |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 26 | M.134 | 193 | FQGDSRSSIFDAKAGIALNDNFVKLVSWYDNEWGYSTRVVD................VAAIKEESEGNLKGILGYVDEDLVSTD |
| 26 | M.283 | 194 | ...........YMFKYDTVHGQWKHHDVKVKDAKTLLFGEKEVAVFGCRNPEEIPWGAAGADYVVESTGVFTDKDKA |
| 26 | M.297 | 195 | FQGDSRSSIFDAKAGIALNDNFVKLVSWYDNEWGYSTRVVDLIRHIHATK........AATYEQIKAAIKEESEGNLKGILGYVDEDLVSTD |
| 26 | M.367 | 196 | FQGDSRSSIFDAKAGIALNDNFVKLVSWYDNEWGYSTRVVDLIRHIHATK........VAAIKEESEGNLKGILGYVDEDLVSTD |
| 26 | M.84 | 197 | GRAASFNIIPSSTGAAKAVGKVLPVLNGKLTGMAFRVPTVDSVVDLTVRLEKAATYEQIKAAIKEESEGNLKGILGYVDEDLVSTD FQGDSRSSIFDAKAGNALNDNFVKLV..........ATQKTVDGPSSKDWRG |
| 26 | M.189 | 198 | .........TYMFKYDTVHGQWKHHDVKVKDAKTLLFGEKEVAVFGCRNPEEIPWGAAGADYVVESTGV |
| 26 | M.586 | 199 | FQGDSRSSIFDAKAGIALNDNFVKLVSWYDNEWGYSTRVVDLIRHIHATK........EESEGNLKGILGYVDEDLVSTD |
| 26 | M.496 | 200 | ......VNDPFITTDYMTYMFKYDTVHGQWKHHDVKVKDAKTLLFGEKEVAVFGCRNPEEIPWGAAGADYVVESTGVFTDKDKAAAH IKGGAKKVIISAPSKDAPMFVCGVNEKEYTSDITIVSNASCTTNCLAPLAKVINDRFGIVEGLMTTVHAMTATQKTVDGPSSKDWRG GRAASFNIIPSSTGAAKAVGKVLPVLNGKLTGMAFRVPTVDSVVDLTVRLEKAATYEQIKAAIKEESEGNLKGILGYVDEDLVSTD FQGDSRSSIFDAKAGIALNDNFVKLVSWYDNEWGY |
| 26 | M.255 | 201 | DVELVAVNDPFITTDYMTYMFKYDTVHGQWKHHDVKVKDAKTLLFGEKEVAVFGCRNPEEIPWGAAGADYVVESTGVFTDKDKAAAH IKGGAKKVIISAPSKDAPMFVCGVNEKEYTSDITIVSNASCTTNCLAPLAKVINDRFGIVEGLMTTVHAMTATQKTVDGPSSKDWRG GRAASFNIIPSSTGAAKAVGKVLPVLNGKLTGMAFRVPTVDSVVDLT |
| 26 | M.471 | 202 | DVELVAVNDPFITTDYMTYMFKYDTVHGQWKHHDVKVKDAKTLLFGEKEVAVFGCRNPEEIPWGAAGADYVVESTGVFTDKDKAAAH IKGGAKKVIISAPSKDAPMFVCGVNEKEYTSDITIVSNASCTTNCLAPLAKVINDRFGIVEGLMTTVHAMTATQKTVDGPSSKDWRG GRAASFNIIPSSTGAAKAVGKVLPVLNG |
| 26 | M.575 | 203 | DVELVAVNDPFITTDYMTYMFKYDTVHGQWKHHDVKVKDAKTLLFGEKEVAVFGCRNPEEIPWGAAGADYVVESTGVFTDKDKAAAH IKGGAKKVIISAPSKDAPMFVCGVNEKEYTSDITIVSNASCTTNCLAPLAKVINDRFGIVEGLMTTVHAMTATQKTVDGPSSKDWRG GRAASFNIIPSSTGAAKAVGKVLPVLNGKLTGMAFRVPTVDSVVDLTVRLEKAATYEQIKAAIKEESEGNLKGILGYVDEDLVSTD FQGDSRSSIFDAKAGIALNDNFVKL |
| 27 | M.163 | 204 | |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 27 | M.314 | 205 | QRTVPPAVPAIVFLSGGQSEEEATVNLNAMYKLQTKKPWFLSFSFGRA................PGSDAKKVAPEVIAEYTVRTL |
| 27 | M.194 | 206 | ................................................VTPGSDAKKVAPEVIAEYTVRTL<br>QRTVPPAVPAIVFLSGGQSEEEATVNLNAMYKLQTKKPWFLSFSFGRALQQSTLKAWSGKEENVEKAQKAFLVRCKANSEATL |
| 27 | M.294 | 207 | ................................................KPNMVTPGSDAKKVAPEVIAEYTVRTL<br>QRTVPPAVPAIVFLSGGQSEEEATVNLNAMYKLQTKKPWFLSFSFGR |
| 27 | M.472 | 208 | ................................................LKPNMVTPGSDAKKVAPEVIAEYTVRTL<br>QRTVPPAVPAIVFLSGGQSEEEATVNLNAMYKLQTKKPWFLSFSFGRALQQSTLKAWSGKEENVEKAQKA |
| 27 | M.369 | 209 | ................................................SQLSIDQNAQ<br>GLARYAIICQENGLVPIVEPEILVDGPHDIERCAYVTEVVLAACYKALNDQHVLLEGSLLKPNMVTPGSDAKKVAPEVIAEYTVRTL<br>QRTVPPAVPAIVFLSGGQSEEEATVNLNAMNKLQTKKPWFLSFSFGRALQQSTLKAWSGKEENVEKAQKAFLVRCKANSEATLGTYK |
| 27 | M.104 | 210 | ................................................VTPGSDAKKVAPEVIAEYTVRTL<br>QRTVPPAVPAIVFLSGGQSEEEATVNLNAMYKLQTKKPWFLSFSFGRALQQSTLKAWSGKEENVEKAQKAFLVRCKANSEATLGTYK<br>GDATLGEGASESLHVKDYKY |
| 27 | M.206 | 211 | ................................................KETTQGHDDLGKRCAKYYEAGARFAKWRAVLKIGPNEPSQLSIDQNAQ<br>GLARYAMLGFRREP |
| 27 | M.24 | 212 | ................................................RFAKWRAVLKIGPNEPSQLSIDQNAQ<br>GLARYAIICQENGLVPIVEPEILVDGPHDIERCAYVTEVVLAACYKALND |
| 27 | M.469 | 213 | ................................................GSLLKPNMVTPGSDAKKVAPEVIAEYTVRTL<br>QRTVPPAVPAIVFLSGGQS |
| 27 | M.420 | 214 | PFANPQTSTMSAYCGKYKDELIKNAAYIGTPGKGILAADESTGTIGKRFASINVENVEDNRRALRELLFTTPGALQHISGVILFEE<br>TLYQSSKAGKPFVDLLKENNVLPGIKVDKGTVELAGTDKETTQGHDDLGKRCAKYYEAGARFAKWRAVLKIGPNEPSQLSIDQNAQ<br>GLARYAIICQENGLVPIVEPEILVDGP<br>VIPPAPHLKRWNRVDTNLESPNDIVPEGAPFTGSGYRIAPYSSILLKATS |
| 28 | M.444 | 215 | VIPPAPHLKRWNRVDTNLESPNDIVPEGAPFTGSGYRIAPYSSILLKATS |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 29 | M.697 | 216 | ............................GGVAAGYAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNPAAAKAKFGTYWKDGKVVGVFLEGGSADENQAIAKVAR AQPPA |
| 29 | M.687 | 217 | ............................GGVAAGYAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNPAAAKAKFGTYWKDGKVVGVFLEGGSADENQAIAKV |
| 29 | M.713 | 218 | .....LPRSFIHPSTDRSLAEMASEKHFKYVILGGGVAAGYAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNPAAAKAKFGTYWKDGKVVGVFLEGGSADENQAIAKVAR AQPPASDLEALGKE |
| 29 | M.638 | 219 | ............................RRRRRGYAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNV |
| 29 | M.673 | 220 | ............................LAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNPAAAKAKFGTYWKDGKVVGVFLEGGSADENQAIAKVAR |
| 29 | M.700 | 221 | ............................KQRASAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNPAAAKAKFGTYWKDGKVVGVFLEGGSADENQAIAKVAR AQPPASDLEALGKE |
| 29 | M.702 | 222 | .....IHPSTDRWLAEMASEKHFKYVILGGGVAAGYAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD VAVVKLKDGRVLDANIVIVGVGGRPLTGLFKGQVDEEKGGLKTDTFFETSVAGVAIGDVASFPMKLYNEPRRVEHVDHARKSAEQA VKAIKAKESGETVAEYDYLPYFYSRSFDIAWQFYGDNPAAAKAKFGTYWKDGKVVGVFLEGGSADEN |
| 29 | M.707 | 223 | .SFRFFLAHSSIHPSTDRSLAEMASEKHFKYVILGGGVAAGYAAREFAKQVQPGELAIISKESVAPYERPALSKGYLFPQNAARLP GFHTCVGSGGEKLLPEWYTEKGIELILSTEIVKADLASKTLTSAAGATFYETLLIATGSSTIKLTDFGVQGAEANNILYLRDINDA DKLVAAMQAKKDGKAVVVGGGYIGLELSAALKLNNFDVTMYPEPWCMPRLFTAGIAHFYEGYYASKGINIVKGTVASGFDADANGD |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 29 | M.710 | 224 | VAVVKLKDGRVLDANIVIVGVGRPLTGLFKGQVDEEKGGLKTDTFFETSVAGVYAIGDVASFPMKLYNEPRRVEHVDHARKSAEQA<br>VKAIKAKESGETVAEYDLPYFYSRSFDIAWQFYGDNVGESVLFEGGSADEN |
| 29 | M.683 | 225 | SSFRFFLAHSSIHPSTDRSLAEMASEKHFKVILGGGVAAGYAAREFAKQCVGPGELAIISKESVAPYERPALSKGYLFPQNAARLP<br>GFHTCVGSGGEKLLPEWYTEKGIELILSTEIVKADLASKTLTSAAGATFTYETLLIATGSSTIKLTDFGVQGAEANNILYLRDINDA<br>DKLVAAMQAKKDGKAVVVGGGYIGLELSAALKLNNPDVTMYPEPWCMPRLFTAGIAHFYEGYYASKGININVKGTVASGFDADANGD<br>VAVVKLKDGRVLDANIVIVGVGRPLTGLFKGQVDEEKGGLKTDTFFETSVAGVYAIGDVASFPMKLYNEPRRVEHVDHARKSAEQA<br>VKAIKAKESGETVAEYDLPYFYSRSFDIAWQFYGDNVGESVLFEGGSADENQAIAKV |
| 30 | M.670 | 226 | ..........AAREFAKQCVGPGELAIISKESVAPYERPALSKGYLFPQNAARLP<br>GFHTCVGSGGEKLLPEWYTEKGIELILSTEIVKADLASKTLTSAAGATFTYETLLIATGSSTIKLTDFGVQGAEANNILYLRDINDA<br>DKLVAAMQAKKDGKAVVVGGGYIGLELSAALKLNNPDVTMYPEPWCMPRLFTAGIAHFYEGYYASKGININVKGTVASGFDADANGD<br>VAVVKLKDGRVLDANIVIVGVGRPLTGLFKGQVDEEKGGLKTDTFFETSVAGVYAIGDVASFPMKLYNEPRRVEHVDHARKSAEQA<br>VKAIKAKESGETVAEYDLPYFYSRSFDIAWQFYGDNVGESVLFEGGSADENQAIAKV |
| 30 | M.643 | 227 | ...MAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHNAFDLLAKYSKSHLVFNDDIQGTASVVLAGLLAALKVIGGGLADQTYLFLGAGEAGTGIAELIALEMSKHTDLPLDDC<br>RKKIWLV |
| 30 | M.663 | 228 | ...MAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHNAFDLLAKYSKSHLVFNDDIQGTASVVLAGLLAALKVIGGGLADQTYLFLGAGEAGTGIAELIALEMSKHTDLPLDDC<br>RKKIWLV |
| 30 | M.664 | 229 | ..REMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHNAFDLLAKYSKSHLVFNDDIQGTASVVLAGLLAALKVIGGGLADQTYLFLGAGEAGTGIAELIALEMSKHTDLPLDDC<br>RKKIWLV |
| 30 | M.666 | 230 | ...MAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHNAFDLLAKYSKSHLVFNDDIQGTASVVLAGLLAALKVIGGGLADQTYLFLGAGEAGTGIAELIALEMSKHTDLPLDDC<br>RKKIWLV |
| 30 | M.748 | 231 | ..REMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHNAFDLLAKYSKSHLVFNDDIQGTASVVLAGLLAALKVIGGGLADQTYLFLGAGEAGTGIAELIALEMSKHTDLPLDDC |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 30 | M.731 | 232 | RKKIWLVDSKGLLVESRKESLQHFKPFAHEHEPLTTLLEAVQSLKPTVLIGTSGVGKTFTQEVVEAMASFNEKPVIFSLSNPTSHS<br>ECTAEEAYTWTKGTAVFASGSPFDVPEYEGKTYVPGQSNNAYVFPGFGLGVVISGAIRVHDDMLLAASEALAEQVSQENFDKGLIFP<br>PFTNIRKISANIAAKVAAKAYDLGLASRLPRPDDLVKYAESCMYTPLYRSYR |
| 30 | M.735 | 233 | ..REMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHHNAFDLLAKYSKSHLVFNDDIQGTASVVLAGLLAALKVIGGGLADQTYLFLGAGEAGTGIAELIALEMSKHTDLPLDDC<br>RKKIWLVDSKGLLVESRKESLQHFKPFAHEHEPLTTLLEAVQSLKPTVLIGTSGVGKTFTQEVVEAMASFNEKPVIFSLSNPTSHS<br>ECTAEEAYTWTKGTAVFASGSPFDVPEYEGKTYVPGQSNNAYVFPGFGLG |
| 30 | M.750 | 234 | ..PEMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHHNAFDLLAKYSKSHLVFNDDIQGTASVVLAGLLAALKVIGGGLADQTYLFLGAGEAGTGIAELIALEMSKHTDLPLDDC<br>RKKIWLVDSKGLLVESRKESLQHFKPFAHEHEPLTTLLEAVQSLKPTVLIGTSGVGKTFTQEVVEAMASFNEKPVIFSLSNPTSHS<br>ECTAEEAYTWTKGTAVFASGSPFDVPEYEGKTYVPGQSNNAYVFPGFGLGVVISGAIRVHDDMLLAASEALAEQVSQENFDKGLIFP<br>PFTNIRKISANIAAKVAAKAYDLGLASRLPRPDDLVKYAESCMYPPLYRSYR |
| 30 | M.752 | 235 | ..PEMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHHNAFDLLAKYSKSHLVFNDDIQGTASVVLAGLLAALKVIGGGLADQTYLFLGAGEAGTGIAELIALEMSKHTDLPLDDC<br>RKKIWLVDSKGLLVESRKESLQHFKPFAHEHEPLTTLLEAVQSLKPTVLIGTSGVGKTFTQEVVEAMASFNEKPVIFSLSNPTSHS<br>ECTAEEAYTWTKGTAVFASGSPFDVPEYEGKTYVPGQSNNAYVFPGFGLGVVISGAIRVHDDMLLAASEALAEQVSQENFDKGLIFP<br>PFTNIRKISANIAAKVAAKAYDLGLASRLPRPDDLVKYAESCMYPPLYRSYR |
| 30 | M.756 | 236 | ..EMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHHNAFDLLAKYSKSHLVFNDDIQGTASVVLAGLLAALKVIGGGLADQTYLFLGAGEAGTGIAELIALEMSKHTDLPLDDC<br>RKKIWLVDSKGLLVESRKESLQHFKPFAHEHEPLTTLLEAVQSLKPTVLIGTSGVGKTFTQEVVEAMASFNEKPVIFSLSNPTSHS<br>ECTAEEAYTWTKGTAVFASGSPFDVPEYEGKTYVPGQSNNAYVFPGFGLGVVISGAIRVHDDMLLAASEALAEQVSQENFDKGLIFP<br>PFTNIRKISANIAAKVAAKAYDLGLASRLPRPDDLVKYAESCMYPPLYRSYR |
| 30 | M.754 | 237 | ..EMAGGGVEDVYGEDRATEEQFVTPWSFSVASGHSLLRDPRHNKGLAFSEAERDAHYLRGLLPPAIVSQEHQEKKIMHNLRQYTV<br>PLQRYIAMMDLQERNERLFYKLLIDNVEELLPVVYTPVVGEACQKYGSIYRRPQGLYISLKDKGKVLEVLKNWPERSIQVIVVTDGE<br>RILGLGDLGCQGMGIPVGKLSLYTALGGVRPSACLPITIDVGTNNQTLLDDEYYIGLKQRRATGEEYHELLQEFMNAVKQNYGEKVL<br>VQFEDFANHHNAFDLLAKYSKSHLVFNDDIQGTASVVLAGLLAALKVIGGGLADQTYLFLGAGEAGTGIAELIALEMSKHTDLPLDDC<br>RKKIWLVDSKGLLVESRKESLQHFKPFAHEHEPLTTLLEAVQSLKPTVLIGTSGVGKTFTQEVVEAMASFNEKPVIFSLSNPTSHS<br>ECTAEEAYTWTKGTAVFASGSPFDVPEYEGKTYVPGQSNNAYVFPGFGLGVVISGAIRVHDDMLLAASEALAEQVSQENFDKGLIFP<br>PFTNIRKISANIAAKVAAKAYDLGLASRLPRPDDLVKYAESCMYPPLYRSYR |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 30 | M.608 | 238 | ...MAGGGVEDVYGEDRATEQFVTPWSFSVASGHSLLRDPRHNKGLAFSEAERDAHYLRGLLPPAIVSQEHQEKKIMHNLRQYTV PLQRYIAMMDLQERNERLFYKLLIDNVEELLPVVYTPVVGEACQKYGSIYRPQGLYISLKDKGKVLEVLLKNWPERSIQVIVTDGE RILGLGDLGCQGMGIPVGKLSLYTALGGVRPSACLPITIDVGTNNQTLLDDEYYIGLKQRRATGEEYHELLQEFMNAVKQNYGEKVL VQFEDFANHNAFPDLLAKYSKSHLVFNDDIQGTASVVLAGLLA |
| 30 | M.740 | 239 | ...GGVEDVYGEDRATEQFVTPWSFSVASGHSLLRDPRHNKGLAFSEAERDAHYLRGLLPPAIVSQEHQEKKIMHNLRQYTV PLQRYIAMMDLQERNERLFYKLLIDNVEELLPVVYTPVVGEACQKYGSIYRRPQGLYISLKDKGKVLEVLLKNWPERSIQVIVTDGE RILGLGDLGCQGMGIPVGKLSLYTALGGVRPSACLPITIDVGTNNQTLLDDEYYIGLKQRRATGEEYHELLQEFMNAVKQNYGEKVL VQFEDFANHNAFPDLLAKYSKSHLVFNDDIQGTASVVLAGLLAALKVIGGGLADQTYLFLGAGEAGTGIAELIALEMSKHTDLPLDDC RKKIWLVDSKGLLVESRKESLQHKFPAHHEPLTTLLEAVGSLKPTVLIGTSGVGKTFTQEVVEAMASFNEKPVIFSLSNPTSHS ECTAEEAYTWTKGTAVFASGSPFDPVEYEGKTYVPQGSNNAVFPGFGLGVVISGAIRVHDDMLLAASEALAEQVSQENFDKGLIFP PFTNIRKISANIAA |
| 31 | M.39 | 240 | ICASGQIIRKGFYLTKNVEHKGQVDLVTETDKACEDLIFNHLRKLYPDHKFIGE |
| 32 | M.303 | 241 | STVHDVVLVGGSTRIPKVQQLLQDFFNGKELCKSINPDEAVAYGAAILSGEGNEKVQDL |
| 31 | M.389 | 242 | VQEFKRKNKDISGNPRALRLRTACERAKRTLSSTAQTTIEIDSLFEGIDFYSTITRARPEELNMDLFRKCMEPVEKCLRDAKMDK |
| 32 | M.390 | 243 | STVHDVVLVGGSTRIPKVQQLLQDFFNGKELCKSINPDEAVAYGAAILSGEGNEKVQDL |
| 32 | M.284 | 244 | VQEFKRKNKDISGNPRALRLRTACERAKRTLSSTAQTTIEIDSLFEGIDFYSTITRARPEELNMDLFRKCMEPVEKCLSDAKMDK |
| 32 | M.201 | 245 | ...........................................................RARPEEMNMDLFRKCMEPVEKCLSDAKMDK |
| 32 | M.28 | 246 | STVHDVVLVGGSTRIPKVQQLLQDFFNGKELCKSINPDEAVAYGA |
| 32 | M.364 | 247 | ..........................................................................................VEKCLRDAKMDK |
| 32 | M.344 | 248 | STVHDVVLVGGSTRIPKVQQLLQDFFNGKELCKSINPDE |
| 32 | M.74 | 249 | RNTTIPTKKEQVFSTYSDNQPGVLIQVYEFERARTRDNNLLGKFELSGIPPAPRGVPQITVCFDIDANGILNVSAEDKTTGQKNKIT ITNDKGRLSKEDIEKMVQEAERYKAEDEE..........................................ETAGGVMTTLIP |
| 32 | M.344 | 248 | RNTTIPTKKEQVFSTYSDNQPGVLIQVYEFERARTRDNNLLGKFELSGIPPAPRGVPQITVCFDIDANGILNVSAEDKTTGQKNKIT ITNDKGRLSKEDIEKMVQEAERYKAEDEE |
| 32 | M.74 | 249 | STVHDVVLVGGSTRIPKVQQLLQDFFNGKELCKSINPDEAVAYGAAILSG |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 32 | M.180 | 250 | ..............................AAILRGEGNEKVQDLLLLDVTPLSLGLETAGGVMTTLIP RNTTIPTKKEQVFSTYSDNQPGVLIQVYEGER |
| 32 | M.317 | 251 | ..............CKSINPDEAVAYGAAVQAAILSGEGNEKVQDLLLLDVTPLSLGLETAGGVMTTVLIP RNTTIPTKKEQVFSTYSDNQPGVLIQVYEGERARTRDNNLLGKFELSGIP |
| 32 | M.298 | 252 | ........RPWRTAPPSRPPSSAARATRRCRTCFLLDVTPLSLGLETAGGVMTTLIP RNTTIPTKKEQVFSTYSDNQPGVLIQVYEGERARTRDNNLLGKFELSGI |
| 32 | M.192 | 253 | ..................KKEQVFSTYSDNQPGVLIQVYEGERTRTRDNNLLGKFELSGIPPAPRGVPQITVCFDIDANGILNVSAEDKTTG |
| 32 | M.77 | 254 | ..............RNTTIPTKKEQVFSTYSDNQPGVLIQVYEGERARTRDNNLLGKFELSGIPPAPRGVPQI |
| 32 | M.92 | 255 | STVHDVVLVGGSTRIPKVQQLLQDFFNGKELCKSINPDEAV ..............LFRKCMEPVEKCLRDAKMDK |
| 32 | M.144 | 256 | STVHDVVLVGGSTRIPKVQQLLQDFFNGKELCKSINPDEAV EELNMDLFRKCMEPVEKCLRDAKMDK |
| 32 | M.9 | 257 | ..............KKEQVFSTYSDNQPGVLIQVYEGERARTKDNNLLGKFELSGIP |
| 33 | M.296 | 258 | KNHLAWNCERCRKGESKKKIDAISEGNDLGKIIAVLSAFVDPPVTK ELIKATDSWMEASEMLYPDYDSMIPDYDTVITNVRRSLAVAK |
| 33 | M.187 | 259 | KNHLAWNCERCRKGESKKTVDAISEGNDLEKIIAILSAFVDAATK ..............YDTVITNVRRSLAVAK |
| 33 | M.172 | 260 | KNHLAWNCERCRKGESKKTVDAISEGNDLEKIIVAILSAFVDAATK ..............YDTVITNVRRSLAVAK |
| 33 | M.72 | 261 | KNHLAWNCERCRKGESKKTVDAILSAFVDAATK ..............YDTVITNVRRSLAVAK |
| 33 | M.38 | 262 | KNHLAWNCERCRKGESKKTVDAISEGNDLEKIVAILSAFVDAATK ..............RSLAVAK |
| 33 | M.239 | 263 | KNHLAWNCERCRKGESKKKIDAISEGNDLGKIIAVLSAFVDPPVTK PDYDSMIPDYDTVITNVRRSLAVAK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 33 | M.289 | 264 | .................................KYGNISLASMIPDYDTVITNVRRSLAVAK KNHLAWNCERCRKGESKKTVDAISEGNDLEKIVAILSAFVDAATK |
| 33 | M.240 | 265 | ................................................YDSMIPDYDTVITNVRRSLAVAK KNHLAWNCERCRKGESKKTVDAISEGNDLEKIVAILSAFVDAATK |
| 33 | M.214 | 266 | ........................................GYNISLASMIPDYDTVITNVRRSLAVAK KNHLAWNCERCRKGESKKTVDAISEGNDLEKIVAILSAFVDAATK |
| 33 | M.365 | 267 | QEMAYWSLKAAIEIGNGAADAASSLYLFGENLPRGADTCYADCHTELIKATDSWMEASEMLYPDYDSMIPDYDTVITNVRRSLAVAK KNHLAWNCERCRKGESKKTVDAISEGNDLEKIVAILSAFVDA |
| 34 | M.614 | 268 | ............EEEVEVAPPQAMEVRVKILFTALCHTDVYFWEAKGTPVFPRIFGHEAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV CVLSCGISTGLGASINVAKPPKGSTVAIFGLGAVGLAAAEGARIIGIDLNANRFEEARKPGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSV |
| 34 | M.598 | 269 | ........NWFCSWVTAAAVAWEAGKPLSIEEVEVAPPQAMEVRVKILFTALCHTDVYFWEAKGTPVFPRIFGHEAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV CVLSCGISTGLGASINVAKPPKGSTVAIFGLGAVGLAAAEGARIAGASRIIGIDLNANRFEEARKPGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSV |
| 34 | M.632 | 270 | ........CKAAVAWEAGKPLSIEEVEVAPPQAMEVRVKILFTALCHTDVYFWEAKGTPVFPRIFGHEAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV CVLSCGISTGLGASINVAKPPKGSTVAIFGLGAVGLAAAEGARIAGASRIIGIDLNANRFEEARKPGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSV |
| 34 | M.633 | 271 | ....................EAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV CVLSCGISTGLGASINVAKPPKGSTVAIFGLGAVGLAAAEGARIAGASRIIGIDLNANRFEEARKPGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSVTFSEINKAFDLMAKGEGIRCIIRMEH |
| 34 | M.616 | 272 | .........................RIFGHEAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV CVLSCGISTGLGASINVAKPPKGSTVAIFGLGAVGLAAAEGARIAGASRIIGIDLNANRFEEARKPGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSVTFSEINKAFDLMAKGEGIRCIIRMEH |
| 34 | M.690 | 273 | ..SFSWICACVRAAAVAWEAGKPLSIEEVEVAPPQAMEVRVKILFTALCHTDVYFWEAKGTPVFPRIFGHEAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV CVLSCGISTGLGASINVAKPPKGSTVAIFGLGAVGLAAAEGARIAGASRIIGIDLNANRFEEARKPGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSVTFSEINKAFDLMAKGEGIRCIIRMEH |
| 34 | M.607 | 274 | LMSFSWICACVRAAAVAWEAGKPLSIEEVEVAPPQAMEVRVKILFTALCHTDVYFWEAKGTPVFPRIFGHEAGGIVESVGEGVTDV APGDHVLPVFTGECKECRHCKSAESNMCDLLRINTDRGVMISDGKSRFSIDGKPIPHFVGTSTFSEYTVMHVGCVAKINPEAPLDKV |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 34 | M.672 | 275 | CVLSCGISTGLGASINVAKPPKGSTVAIFGLGAVGLAAAEGARIAGASRIIGIDLNANRFEEARKFGCTEFVNPKDHTKPVQEVLAE MTDGGVDRSVECTGNINAMIQAFECVHDGWGVAVLVGVPHKDAEFKTHPMNFLNER |
| 34 | M.545 | 276 | ..........VAWEAGKPLSIEEVEVAPPQAMEVRVKILFTALCHTDVYFWEAKGQTPVFPRIFGHEAGGIVESVGEGVTDV APGDHVLPVFTGECKECRHCKSAESNMCDLLRINTDRGVMISDGKSRFSIDGKPIFHFVGTSTFSEYTVMHVGCVAKINPEAPLDKV CVLSCCGISTGLGASINVAKPPKGSTVAIFGLGAVGLAAAEGARIAGASRIIGIDLNANRFEEARKFGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSVTFSEINKAFDLMAKGEGIRCIIRMEH |
| 34 | M.671 | 277 | ..........VFTGECKECRHCKSAESNMCDLLRINTDRGVMISDGKSRFSIDGKPIFHFVGTSTFSEYTVMHVGCVAKINPEAPLDKV CVLSCGISTGLGASINVAKPPKGSTVAIFGLGAVGLAAAEGARIAGASRIIGIDLNANRFEEARKFGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSVT |
| 34 | M.272 | 278 | ..........HEAGGIVESVGEGVTDV APGDHVLPVFTGECKECRHCKSAESNMCDLLRINTDRGVMISDGKSRFSIDGKPIFHFVGTSTFSEYTVMHVGCVAKINPEAPLDKV CVLSCGISTGLGASINVAKPPKGSTVAIFGLGAVGLAAAEGARIAGASRIIGIDLNANRFEEARKFGCTEFVNPKDHTKPVQEVLAE MTDGGVDRSVECTGNINAMIQAFECVHDGWGVAVLVGVPHKDAEFKTHPMNFLNERTLKGTEFGNFKPRTDLPNVVEMYMKKELEVE KFITHSVTFSEINKAFDLMAKGEGIRCIIRMEH |
| 35 | M.272 | 278 | ALRWNLQMGHSVLPKSVSEERIKQNLDVYDWSIPDDLLAKFSEIKQTRLLMGNFIVNKDSVYKTHEELWDGEI |
| 36 | M.301 | 279 | QDFKKVNEIYAKYFPSPAPARSTYQVAALPLDARIEIECIAAL |
| 36 | M.202 | 280 | QDFKKVNEIYAKYFPSPAPARSTYQVAALPLDARIEIECIAAL |
| 37 | M.492 | 281 | MAEDEEAASTLPGLSSSTL |
| 38 | M.647 | 282 | ..........VRVAVDVATMP ALSETARSRGKDAGVSEKTSGAVEEMGFLGAGADADGFPWSNAMLQWQRTGFHFQOPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGLGLRYDWGKFYASKTFYDPAKKRRVLWGWIAETDSERADVTKGWASLM |
| 38 | M.457 | 283 | ............................................AGIAMVYKTKDFVSYELIPGLLHRVDGTFMWECIDFYPVGGNSGEELYV IKESSDDDRHDYYALGSYDAAANKWTPQDPEADLGLGLRYDWGKFYASKTFYDPAKKRRVLWGWIAETDSERADVTKGWASLMSIPR TVDLDEKTRTNLIQWPVEEIETLRINSTDLGGVTIDHGSVFPLPLRHATQLDIEA |
| 38 | M.686 | 284 | ..........GSRGKDAGVSEKTSGAVEEMGFLGAGADADGFPWSNAMLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGLGLRYDWGKFYASKTFYDPAKKRRVLWGWIAETDSERADVTKGWASLMSIPR TVDLDEKTRTNLIQWPVEEIETLRINSTDLGGVTIDHGSVFPLPLRHATQLDIEAA |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 38 | M.495 | 285 | .........KDFRDPTTAWFDDSDQTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLMSIPR TVDLDEKTRTNLIQWPVEEIETLRINSTDLGGVTIDHGSVFPLPLRHATQLDIE |
| 38 | M.486 | 286 | ......LKDFRDPTTAWFDDSDQTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLMSIPR TVDLDEKTRTNLIQWPVEEIETLRINSTDLGGVTIDHGSVFPLPLRH |
| 38 | M.729 | 287 | .........GLKDFRDPTTAWFDDSDQTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLMSIPR TVDLDEKTRTNLIQWPVEEIETLRINSTDLGGVTIDHGSVFPLPLRHATQLDIEAAFRLDHAAVAALNEADVSYNCSTSGGSANRGA LGPFGLLVLADGKEEQTAVYFYVSRGLDGALRTHFCHDESRSSRAKDVVKRVVGYTVPVLDGEAFSVRVLVDHSIVESFAMGGRSTA TSRVYPTEAIYAAAGVYLFNNATSGTVTVEKLVVHEMDSSYNQIFMAEDL |
| 38 | M.760 | 288 | .........QRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLMSIPR TVDLDEKTRTNLIQWPVEEIETLRINSTDLGGVTIDHGSVFPLPLRHATQLDIEAAFRLDHAAVAALNEADVSYNCSTSGGSANRGA LGPFGLLVLADGKEEQTAVYFYVSRGLDGALRTHFCHDESRSSRAKDVVKRVVGYTVPVLDGEAFSVRVLVDHSIVESFAMGGRSTA TSRVYPTEAIYAAAGVYLFNNATSGTVTVEKLVVHEMDSSYNQIFMAEDL |
| 38 | M.668 | 289 | .........GGVRWRPACAAVLAASAVVLVVASGLAGSRVVRVAVDVATMP ALSETARSRGKDAGVSEKTSGAVEEMGFLGAGADADGFPWSNAMLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSER |
| 38 | M.599 | 290 | .........GAVEEMGFLGAGADADGFPWSNAMLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERAD |
| 38 | M.417 | 291 | .........GLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLM |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 38 | M.635 | 292 | ................................................MP ALSETARSRGKDAGVSEKTSGAVEEMGFLGAGADADGFPWSNAMLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLM |
| 38 | M.584 | 293 | ..................................................MLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSER |
| 38 | M.592 | 294 | ..................................................MLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLM |
| 38 | M.709 | 295 | SESTKIFLESSTMESRAIAGTPPLPYAYEPLPHSSDDAAHDRRSGGVRWRACAAVLAASAVVLVVASGLAGSRADRVAVDVATMP ALSETARSRGKDAGVSEKTSGAVEEMGFLGAGADADGFPWSNAMLQWQRTGFHFQPEKNWMNDPNGPVFYRGWYHLFYQYNPEGAVW GNIAWGHAVSRDLIHWRHLPLAMVPDQWYDINGVWTGSATVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLM |
| 38 | M.489 | 296 | ..................................................TVFPDGSLNMLYTGSTNASVQQCLAVPEDPNDSLLRNWTKHPANPVL LPPPGIGLKDFRDPTTAWFDDSDSTWRTVIGSKDDNGHAGIAMVYKTKDFVSYELIPGLLHRVDGTGMWECIDFYPVGGNSGEELYV IKESSDDDRHDYYALGSYDAAANKWTPQDPEADLGIGLRYDWGKFYASKTFYDPAKKRRVLWGWIAETDSERADVTKGWASLM |
| 39 | M.392 | 297 | FVGDKVAYALAQGLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFLVGGASLKPEF |
| 39 | M.347 | 298 | YALAQGLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFL |
| 39 | M.458 | 299 | GDKVAYALAQGLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFLVGGASLKPEFIDIINAATVKSA |
| 39 | M.464 | 300 | PLAVAVAMGRKFFVGGNWKCNGTTDQVDKIVKILNDGKIASTDIVEVVVSPYVFLPTVKDLRPEIQVAAQNCWKKGGAFTGEVS AEMLANLGIPWVILGHSERRALLGESSEFVGDKVAYALAQGLKVIACVGETLEQREAGSTMTVVAEQTKAIADKITDWTNVVIAYEP VWAIGTGKVATPAQAQEVHAN |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 39 | M.415 | 301 | ........................DGKIASTDIVEVVSPPYVFLPTVKDKLRPEIQVAAQNCWKKGGAFTGEVS AEMLANLGIPWVILGHSERRALLGESSEFVGDKVAYALAQGLKVIACVGETLEQREAGSTMTVVAEQTKAIADKITDWTNVVIAYEP VWAIGTGKVATPAQAQEVHANL |
| 39 | M.520 | 302 | .LAVAVAMGRKFFVGGNWKCNGTTDQVDKIVKILNDGKIASTDIVEVVSPPYVFLPTVKDKLRPEIQVAAQNCWKKGGAFTGEVS AEMLANLGIPWVILGHSERRALLGESSEFVGDKVAYALAQGLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFLVGG |
| 39 | M.410 | 303 | ..MLANLGIPWVILGHSERRALLGESSEFVGDKVAYALAQGLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFLVGGASLKPEF |
| 39 | M.467 | 304 | ........LSAEMNHRPVDKIVKILNDGKIASTDIVEVVSPPYVFLPTVKDKLRPEIQVAAQNCWKKGGAFTGEVS AEMLANLGIPWVILGHSERRALLGESSEFVGDKVAYALAQGLKVIACVGETLEQREAGSTMTVVAEQTKAIADKITDWTNVVIAYEP VWAIGTGKVATPAQAQEVHAN |
| 39 | M.494 | 305 | ........................LQKKKKKKFLPTVKDKLRPEIQVAAQNCWKKGGAFTGEVS AEMLANLGIPWVILGHSERRALLGESSEFVGDKVAYALAQGLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFLVGGASLKPEFIDIINAATVKSA |
| 39 | M.374 | 306 | ........................GLKVIACVGETLEQREAGSTMTVVAEQTKAIADKITDWTNVVIAYEP VWAIGTGKVATPAQAQEVHANLRDWLKTNVSPEVAETTRIIYGGSVTGASANELAAQPDVDGFLVGGASLKPEFIDIINAATVKSA |
| 40 | M.118 | 307 | GVWQHDRVEIIANDQGNRTTPSYVAFTDSERLIGDAAKNQVAMNPINTVFGEHLSTCTPYTTRS |
| 41 | M.346 | 308 | SSTRGWCSRRRAGRGTSS |
| 42 | M.318 | 309 | IPGPAEKPMIVVKYKGEEKQFAAEEISSMVLIKMREIAEAFLGNSIKNAVVTVPAYFNDSQRQATKDAGVIAGLNVLRIINEPTAAA IAYGLLDKKSTSTGEKNVLIF |
| 43 | M.519 | 310 | ..LDFVWYEPLTYNTEDEFAAHRAREFTLGWFMHPITYGHYPETMQRLVADRLPNFTDEQTRLLQGSADIVGVNHYTTYYAKNHEN LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYVDRKTFTRYPKDSTRWFRKVIKNEE |
| 43 | M.600 | 311 | ..LDFVWYEPLTYNTEDEFAAHRAREFTLGWFMHPITYGHYPETMQRLVADRLPNFTDEQTRLLQGSADIVGVNHYTTYYAKNHEN LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYVDRKTFTRYPKDSTRWFRKVIKNEE |
| 43 | M.254 | 312 | ........................HALYDKFRIDYFDQYL HELKRATDDGARVTGYFAWSLLDNFEWRMGFTSKFGIVYVDRKTFTRYPKDSTRWFRKVIKNEE |
| 43 | M.438 | 313 | ........................IVGVNHYTTYYAKNHEN LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYVDRKTFTRYPKDSTRWFRKVIKNEE |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 43 | M.479 | 314 | ................................FMHPITYGHYPETMQRLVADRLPNFTDEQTRLLQGSADIVGVNHYTTYYAKNHEN LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 43 | M.523 | 315 | GILLDFVWYEPLTYNTEDEFAAHRAREFTLGWFMHPITYGHYPETMQRLVADRLPNFTDEQTRLLQGSADIVGVNHYTTYYAKNHEN LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 43 | M.380 | 316 | ................................................................VVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 43 | M.480 | 317 | ................................................................VVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 43 | M.371 | 318 | ................................................................VVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVI |
| 43 | M.482 | 319 | ................................................................VVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 43 | M.261 | 320 | ................................................................................................................PHALYDKFRIDYFDQYL HELKRATDDGARVTGYFAWSLLDNFEWRMGFTSKFGIVYYDRKTFTRYPKDSTRWFRKVIKNEE |
| 43 | M.108 | 321 | ................................................................................................................PHALYDKFRIDYFDQYL HELKRATDDGARVTGYFAWSLLDNFEWRMGFTSKFGIVYYDRKTFTRYPKDSTRWFRKVIKNEE |
| 43 | M.260 | 322 | .................................................................................................................HALYDKFRIDYFDQYL HELKRATDDGARVTGYFAWSLLDNFEWRMGFTSKFGIVYYDRKTFTRYPKDSTRWFRKVIKNEE |
| 43 | M.556 | 323 | LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 43 | M.461 | 324 | ................................................................DRLPNFTDEQTRLLQGSADIVGVNHYTTYYAKNHEN LTHMSYANDWQVQLVVERNGIPIGKQGYSKWLYVVPWGFYKAVMHVKDKYRNPLMIIGENGIDQSGSDTLPHALYDKFRIDYFDQYL HELKRATDDGARVTGYFAWSLLDNFEWRMGFTSKFGIVYYDRKTFTRYPKDSTRWFRKVIKNEE |
| 44 | M.400 | 325 | GYDDIPKEVTDPDAKKPEDMDDEEDGEWTAPTIPNPEYKGPWKQKKIKNPNYQGKWNAPMTANPDFKDDPYIYAFDSLKYIG IELWQVKSGTLFDNILITDDAALAKTFAEETWAKHDAEKAAFDEAKKKEEDASKAGEDDDLDDEDADDE |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 44 | M.474 | 326 | .....GYDDIPKEVTDPDAKKPEDWDDEEDGEWTAPTIPNPEYKGPWKQKKIKNPNYQGKWNAPMIANPDFKDDPYIYAFDSLKYIG IELWQVKSGTLFDNILITDDAALAKTFAEETWAKHDAEKAAFDEAKKKEEDASKAGEDDDLLDEDADDEDKDDKAESDAEDHS DDEKHDEL |
| 44 | M.490 | 327 | .....GYDDIPKEVTDPDAKKPEDWDDEEDGEWTAPTIPNPEYKGPWKQKKIKNPNYQGKWNAPMIANPDFKDDPYIYAFDSLKYIG IELWQVKSGTLFDNILITDDAALAKTFAEETWAKHDAEKAAFDEAKKKEEDASKAGEDDDLLDEDADDEDKDDKAESDAEDHS DDEKHDEL |
| 44 | M.491 | 328 | .....GYDDIPKEVTDPDAKKPEDWDDEEDGEWTAPTIPNPEYKGPWKQKKIKNPNYQGKWNAPMIANPDFKDDPYIYAFDSLKYIG IELWQVKSGTLFDNILITDDAALAKTFAEETWAKHDAEKAAFDEAKKKEEDASKAGEDDDLLDEDADDEDKDDKAESDAEDHS DDEKHDEL |
| 44 | M.401 | 329 | ...............................KIKNPNYQGKWKAPMIANPDFKDDPYIYAFDSLKYIG IELWQVKSGTLFDNILITDDAALAKTFAEETWAKHDAEKAAFDEAKKKEEDASKAGEDDDLLDEDADDEDKDDKAESDAEDHS DDEKHDEL |
| 44 | M.470 | 330 | .....KEVTDPDAKKPEDWDDEEDGEWTAPTIPNPEYKGPWKQKKIKNPNYQGKWNAPMIANPDFKDDPYIYAFDSLKYIG IELWQVKSGTLFDNILITDDAALAKTFAEETWAKHDAEKAAFDEAKKKEEDASKAGEDDDLLDEDADDEDKDDKAESDAEDHS DDEKHDEL |
| 44 | M.409 | 331 | ................................................MIANPDFKDDPYIYAFDSLKYIG IELWQVKSGTLFDNILITDDAALAKTFAEETWAKHDAEKAAFDEAKKKEEDASKAGEDDDLDDEDADDE |
| 44 | M.435 | 332 | ................................................MIANPDFKDDPYIYAFDSLKYIG IELWQVKSGTLFDNILITDDAALAKTFAEETWAKHDAEKAAFDEAKKKEEDASKAGEDDDLDDEDADDE |
| 44 | M.553 | 333 | ................................................MIANPDFKDDPYIYAFDSLKYIG IELWQVKSGTLFDNILITDDAALAKTFAEETWAKHDAEKAAFDEAKKKEEDASKAGEDDDLDDEDADDEDKDAESDAEDHS |
| 44 | M.537 | 334 | ................................................MIANPDFKDDPYIYAFDSLKYIG IELWQVKSGTLFDNILITDDAALAKTFAEETWAKHDAEKAAFDEAKKKEEDASKAGEDDDLDDEDADDEDKDAESDAEDHS DDEKHDEL |
| 45 | M.402 | 335 | MARMKRPPRCCQDLVVLPL |
| 45 | M.481 | 336 | ........MNNMSSR |
| 45 | M.483 | 337 | ........MNNMSSR |
| 45 | M.554 | 338 | MARMKRPPRCCQDLVVLPL |
| 45 | M.538 | 339 | MARMKRPPRCCQDLVVLPL |
| 46 | M.234 | 340 | QARGLLRRARGGPHHRRQRGAHRRVPLRPLRHRVRVHGQEGRRAKLRSAGEVEIQFRRVCCKYPEGTKVTFHVEKGSNPN |
| 46 | M.237 | 341 | QARGLLRRARGGPHHRRQRGAHRRVPLRPLRHRVRVHGQEGRRAKLRSAGEVEIQFRRVCCKYPEGTKVTFHVVGVGPLLH |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 46 | M.264 | 342 | QARGLLRRARGGPHHRRQRGAHRRVPLRPLRHRVRVHGQEGRRAKLRSAGEVEIQPRRVCCKYPEGTKVTPHVEKGSNPNSTWGCW |
| 47 | M.563 | 343 | .TDAAAPAPAAAAASKWNLLTFDTEEDVAVSLAKYTAELSGKFAAERGAFTVVLSGGTLIETLRKLAEPPYLETVQWSKWHVFWVDE RVVPKDHVDSNYKLAVDGLLSKVPIPTDQVVAINDTLSAEGAAADYETVLKQLVKSGVLAMSTATGFPRFDLMLLGMGPDGHLASLF PGHPLLNENQKWVTHIMDSPKPPPQRITFTFPVIKSSAYYAMVVTGPGEASAVKKVLSDDKTLPLLPTEMAILQDGEFTWFTDKPAV SMLQNK |
| 47 | M.566 | 344 | ATDAAAPAPAAAAASKWNLLTFDTEEDVAVSLAKYTAELSGKFAAERGAFTVVLSGGTLIDTLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.532 | 345 | .........GGTLIETLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.557 | 346 | .........AAAASKWNLLTFDTEEDVAVSLAKYTAELSGKFAAERGAFTVVLSGGTLIETLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.573 | 347 | .........AAAASKWNLLTFDTEEDVAVSLAKYTAELSGKFAAERGAFTVVLSGGTLIDTLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.549 | 348 | .........AAAASKWNLLTFDTEEDVAVSLAKYTAELSGKFAAERGAFTVVLSGGTLIETLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.550 | 349 | .........AAAASKWNLLTFDTEEDVAVSLAKYTAELSGKFAAERGAFTVVLSGGTLIDTLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.551 | 350 | .........AAAASKWNLLTFDTEEDVAVSLAKYTAELSGKFAAERGAFTVVLSGGTLIDTLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |
| 47 | M.558 | 351 | .....TDAAAPAAAASKWNLLTFDTEGDVAVSLAKYTAELSGKFAAERGAFTVVLSGGTLIDTLRKLAEPPYLETVQWSKWHVFWVDE RVVPKDHVDSNYKLAVDGLLSKVPIPTDQVYAINDTLSAEGAAADYETVLKQLVKSGVLAMSTATGFPRFDLMLLGMGPDGHLASLF PGHPLLNENQKWVTHIMDSPKPPPQRITFTFPVIKSSAYVAMVVTGPGEASAVKKVLSDDKTLPLLPTEMAILQDGEFTWFTDKPAV SMLQNK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 47 | M.463 | 352 | ...ATDAAPAAASKWNLLTFDTEGDVAVSLAKYTAELSGKFAAERGAFTVVLSGGTLIDTLRKLAEPPYLETVQMSKWHVFWDE RVVPKDHVDSNYKLAVDGLLLSKVPIPTDQVVAINDTLSAEGAAADYETVLKQLVKSGVLAMSTATGFPRFDLMLGMPDGHLASLF PGHPLLNENQKWVTHIMDSPKPPP |
| 48 | M.684 | 353 | ..............RAHIAFYQVCFEQKGCDRDDILA AVDEAIEDGVDVLSLSLGGNPGADFSEDPVSLGGYTAALNGVFVSTAAGNIGPNPATLSNGAPWLLTVGASTSDRRFAATVKLGSGL EVDGESLTEPKDYGKEMVPLVRMDGGGQCTSESVLKAQNITGKIIICEAGGGVSTAKAKMVLRAGAFGMIVVAPAVFGPVIVPRPHV LPTVQVPYAVGQKIKAYLEAESSPTANFIFKGTLFDTPRSPMMAPSSRGPNVKSRGILKPDIIGPGVNVLAGVPGVVDMALQPKEV MPKFDIKSGTSMSCPHLAGIAALLKNAHPTWSPASIKSALMTTETTDNTKKPIADVDGTQATYFATGAGHVNPKKAMDPGLVYNLT AAEYIPYLCGLKYTDQQVNSIIHP |
| 48 | M.739 | 354 | ..............RAHIAFYQVCFEQKGCDRDDILA AVDEAIEDGVDVLSLSLGGNPGADFSEDPVSLGGYTAALNGVFVSTAAGNIGPNPATLSNGAPWLLTVGASTSDRRFAATVKLGSGL EVDGESLTEPKDYGKEMVPLVRMDGGGQCTSESVLKAQNITGKIIICEAGGGVSTAKAKMVLRAGAFGMIVVAPAVFGPVIVPRPHV LPTVQVPYAVGQKIKAYLEAESSPTANFIFKGTLFDTPRSPMMAPSSRGPNVKSRGILKPDIIGPGVNVLAGVPGVVDMALQPKEV MPKFDIKSGTSMSCPHLAGIAALLKNAHPTWSPASIKSALMTTETTDNTKKPIADVDGTQATYFATGAGHVNPKKAMDPGLVYNLT AAEYIPYLCGLKYTDQQVNSITVVTVKTAAVPDGAIEGQLKWVSSKHIVRSPILILPGTGEEDTTEAAAPSAQP |
| 48 | M.637 | 355 | ............................FGMIVVAPAVFGPVIVPRPHV LPTVQVPYAVGQKIKAYLEAESSPTANFIFKGTLFDTPRSPMMAPSSRGPNVKSRGILKPDIIGPGVNVLAGVPGVVDMALQPKEV MPKFDIKSGTSMSCPHLAGIAALLKNAHPTWSPASIKSALMTTETTDNTKKPIADVDGTQATYFATGAGHVNPKKAMDPGLVYNLT AAEYIPYLCGLKYTDQQVNSITVVTVKTAAVPDGAIEGQLKWVSSKHIVRSPILILPGTGEEDTTEAAAPSAQP |
| 48 | M.517 | 356 | .NKLIGARSFFESAKWKWKGLDDPVLPINEGQHGTHTSSTAAGAFVRGANISGNAVGTAAGMAPRAHIAFYQVCFEQKGCDRDDILA AVDEAIEDGVDVLSLSLGGNPGADFSEDPVSLGGYTAALNGVFVSTAAGNIGPNPATLSNGAPWLLTVGASTSDRRFAATVKLGSGL EVDGESLTEPKDYGKEMVPLVRMDGGGQCTSESVLKAQNITGKIIICEAGGGVSTAKAKMVLRA |
| 48 | M.712 | 357 | ...............TVGASTSDRRFAATVKLGSGL EVDGESLTEPKDYGKEMVPLVRMDGGGQCTSESVLKAQNITGKIIICEAGGGVSTAKAKMVLRAGAFGMIVVAPAVFGPVIVPRPHV LPTVQVPYAVGQKIKAYLEAESSPTANFIFKGTLFDTPRSPMMAPSSRGPNVKSRGILKPDIIGPGVNVLAGVPGVVDMALQPKEV MPKFDIKSGTSMSCPHLAGIAALLKNAHPTWSPASIKSALMTTETTDNTKKPIADVDGTQATYFATGAGHVNASRAVTNVGVASSTYDVEVEVPKSVTVEV AAEYIPYLCGLKYTDQQVNSITVVTVKTAAVPDGAIEGQLKWVSSKHIVRSPILILPGTGEEDTTEAAAPSAQP |
| 48 | M.732 | 358 | ..............HIAFYQVCFEQKGCDRDDILA AVDEAIEDGVDVLSLSLGGNPGADFSEDPVSLGGYTAALNGVFVSTAAGNIGPNPATLSNGAPWLLTVGASTSDRRFAATVKLGSGL EVDGESLTEPKDYGKEMVPLVRMDGGGQCTSESVLKAQNITGKIIICEAGGGVSTAKAKMVLRAGAFGMIVVAPAVFGPVIVPRPHV LPTVQVPYAVGQKIKAYLEAESSPTANFIFKGTLFDTPRSPMMAPSSRGPNVKSRGILKPDIIGPGVNVLAGVPGVVDMALQPKEV MPKFDIKSGTSMSCPHLAGIAALLKNAHPTWSPASIKSALMTTETTDNTKKPIADVDGTQATYFATGAGHVNASRAVTNVGVASSTYDVEVEVPKSVTVEV AAEYIPYLCGLKYTDQQVNSITVVTVKTAAVPDGAIE |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 48 | M.711 | 359 | ........................................................GASTSDRRFAATVKLGSGL<br>EVDGESLTEPKDYGKEMVPLVRMDGGGQCTSESVLKAQNITGKIIICEAGGGVSTAKAKMVLRAGAFGMIVVAPAVFGPVIVPRPHV<br>LPTVQVPYAVGQKIKAYLEAESSPTANFIFKGTLFDTPRSPMMAPFSSRGPNVKSRGILKPDIIGPGVNVLAGVPGVVDMALQPKEV<br>MPKFDIKSGTSMSCPHLAGIAALLKNAHPTWSPASIKSALMTTETTDNTKKPIADVDGTQATYFATGAGHVNPKKAMDPGLVYNLT<br>AAEYIPYLCGLKYTDQQVNSIIHPEPPVTCDKLRKLDQKDLNYPSITVVVDKADSVVNASRAVTNVGVASSTYDVEVEVPKSVTVEV<br>HPPKLTFKALEVLNYTVTVKTAAVPDGAIEGQLKNV |
| 48 | M.730 | 360 | ................................................................GCDRDDILA<br>AVDEAIEDGVDVLSLSLGGNPGADFSEDPVSLGGYTAALNGVFVSTAAGNIGPNPATLSNGAPWLLTVGASTSDRRFAATVKLGSGL<br>EVDGESLTEPKDYGKEMVPLVRMDGGGQCTSESVLKAQNITGKIIICEAGGGVSTAKAKMVLGADAFGMIVVAPAVFGPVIVPRPHV<br>LPTVQVPYAVGQKIKAYLEAESSPTANFIFKGTLFDTPRSPMMAPFSSRGPNVKSRGILKPDIIGPGVNVLAGVPGVVDMALQPKEV<br>MPKFDIKSGTSMSCPHLAGIAALLKNAHPTWSPASIKSALMTTETTDNTKKPIADVDGTQATYFATGAGHVNPKKAMDPGLVYNLT<br>AAEYIPYLCGLKYTDQQVNSIIHPEPPVTCDKLRKLDQKDLNYPSITVVVDKADSVVNASRAVTNVGVASSTYDVEVEVPKSVTVEV<br>HPPKLTFKALEVLNYTVTVKTAAVPDGAIEGQLKWV |
| 48 | M.736 | 361 | ................................................................GCDRDDILA<br>AVDEAIEDGVDVLSLSLGGNPGADFSEDPVSLGGYTAALNGVFVSTAAGNIGPNPATLSNGAPWLLTVGASTSDRRFAATVKLGSGL<br>EVDGESLTEPKDYGKEMVPLVRMDGGGQCTSESVLKAQNITGKIIICEAGGGVSTAKAKMVLRAGAFGMIVVAPAVFGPVIVPRPHV<br>LPTVQVPYAVGQKIKAYLEAESSPTANFIFKGTLFDTPRSPMMAPFSSRGPNVKSRGILKPDIIGPGVNVLAGVPGVVDMALQPKEV<br>MPKFDIKSGTSMSCPHLAGIAALLKNAHPTWSPASIKSALMTTETTDNTKKPIADVDGTQATYFATGAGHVNPKKAMDPGLVYNLT<br>AAEYIPYLCGLKYTDQQVNSIIHPEPPVTCDKLRKLDQKDLNYPSITVVVDKADSVVNASRAVTNVGVASSTYDVEVEVPKSVTVEV<br>HPPKLTFKALEVLNYTVTVKTAAVPDGAIEGQLKWVSSKHIVRSPILILPGTGEEDTTEAAAPSAQP |
| 48 | M.737 | 362 | ................................................................GCDRDDILA<br>AVDEAIEDGVDVLSLSLGGNPGADFSEDPVSLGGYTAALNGVFVSTAAGNIGPNPATLSNGAPWLLTVGASTSDRRFAATVKLGSGL<br>EVDGESLTEPKDYGKEMVPLVRMDGGGQCTSESVLKAQNITGKIIICEAGGGVSTAKAKMVLGADAFGMIVVAPAVFGPVIVPRPHV<br>LPTVQVPYAVGQKIKAYLEAESSPTANFIFKGTLFDTPRSPMMAPFSSRGPNVKSRGILKPDIIGPGVNVLAGVPGVVDMALQPKEV<br>MPKFDIKSGTSMSCPHLAGIAALLKNAHPTWSPASIKSALMTTETTDNTKKPIADVDGTQATYFATGAGHVNPKKAMDPGLVYNLT<br>AAEYIPYLCGLKYTDQQVNSIIHPEPPVTCDKLRKLDQKDLNYPSITVVVDKADSVVNASRAVTNVGVASSTYDVEVEVPKSVTVEV<br>HPPKLTFKALEVLNYTVTVKTAAVPDGAIEGQLKWVSSKHIVRSPILILPGTGEEDTTEAAAPSAQP |
| 48 | M.247 | 363 | NNKLIGARSFFESAKNKWKGLDDPVLPINEGQHGTHTSSTAAGAFVRGANISGNAVFTAAGMAPRAHIAFYQVCFEQKGCD |
| 49 | M.13 | 364 | ..........PRSWSAVMLTFDNAGMNVRSNVWERHYLGEQLYISVISPARSL |
| 49 | M.57 | 365 | ..........VSRHSIQVYPRSWSAVMLTFDNAGMNVRSNVWERHYLGEQLYISVISPARSLRDEY |
| 49 | M.61 | 366 | ELRKTYNLLDAVSRHSIQVYPRSWSAVMLTFDNAGMNVRSNVWERHYLGEMTLM |
| 49 | M.47 | 367 | ELRKTYNLLDAVSRHSIQVYPRSWSAVMLTFDNAGMNVRSNVWERHYLGEMTLM |
| 49 | M.43 | 368 | ELRKTYNLLDAVSRHSIQVYPRSWSAVMLTFDNAGMNVRSNVWERHYLGEQLYI |
| 49 | M.32 | 369 | ....TYNLLDAVSRHSIQVYPRSWSAVMLTFDNAGMNVRSNVWERHYLAGEMTLM |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 50 | M.518 | 370 | RGGFSGLFPDSSEYARFTAVSSMPGVLFCDLKFSSDVGFCIGNLRLDNTTLIKDFASRGSTYQVNGQDVQGWFSLDFSKSKELH EIPMIQNILSRSQIFDGIPNLMSLDNVVKIVDPNEIWVNVEYDSFYREHGLSSEDYILGLPKEFPVTWVSSPEVALLKSLAGKLRNS TKLIFRFLREDLVEPTTKMTYGELLKDLKSIKAFASGILVPKQFIWPMNKDMYLEPSTSLVKDAH |
| 51 | M.267 | 371 | .....KIETELTKICEGILKLLETHLVPSSTAPESKVFYLKMKGDYHRYLAEFKSGAERKEAAESTMNSYKAAQDIALADLAPTHPI RLGLAL |
| 51 | M.73 | 372 | RLGLALKIS |
| 51 | M.270 | 373 | KDYRGKIETELTKICEGILKLLETHLVPSSTAPESKVFYLKMKGDYHRYLAEFKSGAERKEAAESTMNSYKAAQDIALADLAPTHPI RLG |
| 51 | M.150 | 374 | RLGLALNF |
| 52 | M.366 | 375 | ..........SAGAAESKVFYLKMKGDYHRYLAEFKSGAERKEAAESTMNSYKAAQDIALADLAPTHPI |
| 52 | M.679 | 376 | ..........VSCADIVALGTRDAVRISGPAYEVPTGRRDSLVSNREEADNNLPGPDIPIPKLTSEFLSRGFTPEEMVV LLAGGHSIGKVRCIFIEPDATPMDPGYQASISKLCDGPNRDTGFVNMDEHNPNVGEVA |
| 52 | M.680 | 377 | LLGLLAPLASAQLSREFYKASCPDAEKIVAAVIEKKLKEDPGPAAGLLRLLFHDCFANGCDASILIDPLSNQSAEKEAGPNISVRGF EVIDDIKKELEAKCPKTVSCADIVALGTRDAVRISGGPAYEVPTGRRDSLVSNREEADNNLPGPDIPIPKLTSEFLSRGFTPEEMVV LLAGGHSIGKVRCIFIEPDATPMDPGYQASISKLCDGPNRDTGFVNMDEHNPVIDSSYFANVLAKKMPLTVDRLLGLDSKTTPIIK NMLNKPNDFMPTFAKAMEKLSVLKVITGKDGEIRKSCSEFNNPMPSTGGSVIRISSANPEDLEGLSSGGTQVAGIVSQGTKDPWHVK TLKAAGAAHPKKVTGRHPKLRGAHPQ |
| 52 | M.230 | 378 | ..........GCDASILIDPLSNQSAEKEAGPNISVRGF EVIDDIKKELEAKCPKTVSCADIVALGTRDAVRISG |
| 52 | M.530 | 379 | ..........PAYEVPTGRRDSLVSNREEADNNLPGPDIPIPKLTSEFLSRGFTPEEMVV LLAGGHSIGKVRCIFIEPDATPMDPGYQASISKLCDGPNRDTGFVNMDEHNPVIDSSYFANVLAKKMPLTVDRLLGLDSKTTPIIK NMLNKPNDFMPTFAKAMEKLSVLKVIAGKDGEIRKSCSEFNNPMPSTGGSVIRISSANPEDLEGLSSGGTQVAGIVSQGTKDPWHVK TLKAAGAAHPKKVTGRHPKLRGA |
| 52 | M.667 | 380 | LLGLLAPLASAQLSREFYKASCPDAEKIVAAVIEKKLKEDPGTAAGLLRLLFHDCFANGCDASILIDPLSNQSAEKEAGPNISVRGF EVIDDIKKELEAKCPKTVSCADIVALGTRDAVRISGGPAYEVPTGRRDSLVSNREEADNNLPGPDIPIPKLTSEFLSRGFTPEEMVV LLAGGHSIGKVRCIFIEPDATPMDPGYQASISKLCDGPNRDTGFVNMDEHNPVIDSSYFANVLAKKMPLTVDRLLGLDSKTTPIIK NMLNKPNDFMPTFAKAMEKLSVLKAIPGKDGEIRKSCSEFNNPMPSTGGSVIRISSANPEDLEGLSSGGTQVAGIVSQGTKDPWHVK TLKAAGAAHPKKVTGRHPKLRGAHPQ |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 52 | M.505 | 381 | LLGLLAPLASAQLSREFYKASCPDAEKIVAAVIEKKLKEDPGTAAGLLRLLFHDCFANGCDASIILDPLSNQSAEKEAGPNISVRGF EVIDDIKKELEAKCPKTVSCADIVALGTRDAVRISGPAYFVPTGRDSLVSNREEADNNLPGPDIPIPKLTSEFLSRGFTPEEMVV LLAAGGHSIGKVRCIFIEPDATPMDPGYQASISKLCDGPNRDTGFVNMDEHNPN |
| 52 | M.488 | 382 | ..........KASCPDAEKIVAAVIEKKLKEDPGTAAGLLRLLFHDCFANGCDASIILDPLSNQSAEKEAGPNISVRGF EVIDDIKKELEAKCPKTVSCADIVALGTRDAVRISGPAYFVPTGRDSLVSNREEADNNLPGPDIPIPKLTSEFLSRGFTPEEMVV LLAAGGHSIGKVRCIFIEPDATPMDPGYQASISKLCDGPNRDTGFVNMDEHNPNVIDSSYF |
| 52 | M.445 | 383 | ..........LFHDCFANGCDASIILDPLSNQSAEKEAGPNISVRGF EVIDDIKKELEAKCPKTVSCADIVALGTRDAVRISGPAYFVPTGRDSLVSNREEADNNLPGPDIPIPKLTSEFLSRGFTPEEMVV LLAAGGHSIGKVRCIFIEPDATPMDPGYQASISKLCDGPNRDTGFVNMDEHNPN |
| 53 | M.436 | 384 | WSEIQTLKPNLIGPFAAAGMDRNPVAKNAGKFMTLAGFLDYAKASNISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVL |
| 53 | M.508 | 385 | ..IQTLKPNLIGPFAAAGMDRNPVAKNAGKFMTLAGFLDYAKASNISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMSLAFDYWADPMVEIATDTWSVLADGLVTEFPSTAAAYFSKWWYLLLDKTV |
| 53 | M.688 | 386 | ..EIQTLKPNLIGPFAAAGMDRNPVAKNAGKFMTLAGFLDYAKASNISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMSLAFDYWADPMVEIATDTWSVLADGLVTEFPSTAAAYFRSPCSDIKRNMSYTIKPGEPGALVDMAAYGALPPAPPAPVLEPAD VHRQPLPLCPTEPMRTFRCRLPPKETGKNAEYTANLAADG |
| 53 | M.613 | 387 | .SEIQTLKPNLIGPFAAAGMDRNPVAKNAGKFMTLAGFLDYAKASNISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMSLAFDYWADPMVEIATDTWSVLADGLVTEFPSTAAAYFRSPCSDIKRNMSYTIKPGEPGALVDMAAYGALPPAPPAPVLEPAD VHRQPLPLCPTEPMRTFRCRLPPKETGKNAEYTANLAADG |
| 53 | M.487 | 388 | .SEIQTLKPNLIGPFAAAGMDRNPVAKNAGKFMTLAGFLDYAKASNISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMSLAFDYWADPMVEIATDTWSVLADGLVTEFPSTAAAYF |
| 53 | M.552 | 389 | ..........ISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMSLAFDYWADPMVEIATDTWSVLADGLVTEFPSTAAAYFRSPCSDIKRNMSYTIKPGEPGALVDMAAYGALPPAPPAPVLEPAD VHRQPLPLCPTEPMRTFRCRLPPKETGKNAEYTANLAADG |
| 53 | M.572 | 390 | ..........HAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMSLAFDYWADPMVEIATDTWSVLADGLVTEFPSTAAAYFRSPCSDIKRNMSYTIKPGEPGALVDMAAYGALPPAPPAPVLEPAD VHRQPLPLCPTEPMRTFRCRLPPKETGKNAEYTANLAADG |
| 53 | M.366 | 391 | ..........LDVVDAVSNALIKSGYDKETKQQ VFIQSEDPPVLSAFKKFPKFNRVFEIEFDIRDVSKPSVVEIKEFANAVKLRRSSAAQVDGFYLTGFNAVVERLRDADIQVHVGVLKN EFMS |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 53 | M.534 | 392 | WSEIQTLKPNLIGPFAAAGMDRNPVAKNAGKFMTLAGFLDYAKASNISGILIGIEHAAYLATRGLDVDAVSNALIKSGYDKETKQQ VFIQSEDPPVLSAFKKFPKFNRVFEIEFDIRDVSKPSVVEIKEFANAVKLRRSSAAQVDGFYLTGNAVVERLRDADIQVHVGVLKN EFMSLAFDYWADPMVEIATDTWSVLADGLVTEFPSTAAAYPRSPCCSDIKRNMSYTIKPGEPGALVDMAAYGALPPAPP |
| 54 | M.213 | 393 | ..........................QPKDQIGSFFYFPSIGMQRTVGGYGLISVVSRLLIPVPFDPPADDLQVIIGDWYTKD...........................DGLPGTNCPVAPGTNFTYKW |
| 54 | M.384 | 394 | HVPLEEHVGTKTVLGVPQKVILINGEFPGPRINCSSNNNIVVNVFNQLDQPLLFTWNGIQHRKNSWQDGLPGTNCPVAPGTNFTYKW QPKDQIGSFFYFPSIGMQRTVGGYGLISVVSRLLIPVPFDPPADDLQVIIGDWYTKDH |
| 54 | M.220 | 395 | ..........................QPKDQIGSFFYFPSIGMQRTVGGYGLISVVSRLLIPVPFDPPADDLQVIIGDWYTKDH...........................DGLPGTNCPVAPGTNFTYKW |
| 54 | M.147 | 396 | ..........................QPKDQIGSFFYFPSIGMQRTVGGYGLISVVSRLLIPVPFDPP..........................................VAPGTNFTYKW |
| 54 | M.127 | 397 | ..........................QPKDQIGSFFYFPSIGMQRTVGGYGLISVVSRLLIPVPFDPPADDLQVIIGDWYTKDH...........................TNFTYKW |
| 54 | M.145 | 398 | ..........................QPKDQIGSFFYFPSIGMQRTVGGYGLISVVSRLLIPVPFDPPADDLQVIIGDWYTKDHTV...........................TNFTYKW |
| 55 | M.33 | 399 | ..........................PKFPRRVLVIDPVISGASKPSIGEIKGFADAVMVSRGSLVRVNGFFLT |
| 55 | M.110 | 400 | SVLSVFKKFPPKFPRRVLVIDPVISGASKPSIGEIKGFADAVMVSRGSLVRVNGFFLT |
| 55 | M.173 | 401 | ..VFIQSDDSSVLSVFKKFPPKFPRRVLVIDPVISGASKPSIGEIKGFADAVMVSRGSLVRVNGFFPT |
| 55 | M.50 | 402 | ..LNTESTEEFPKFPRRVLVIDPVISGASKPSIGEIKGFADAVMVSRGSLVRVNGFFLT |
| 55 | M.249 | 403 | QQVFIQSDDSSVLSVFKKFPPKFPRRVLVIDPVISGASKPSIGEIKGFADAVMVSRGSLVRVNGFFLTGFNDLVTEIHDANLSLH |
| 55 | M.18 | 404 | ..........TEEFPKFPRRVLVIDPVISGASKPSIGEIKGFADAVMVSRGSLVRVNGFF |
| 56 | M.5 | 405 | ..........RQPGPLRGLNTKIASFLDPDGWKVLVDHADFLKELH |
| 56 | M.25 | 406 | TKELGGKILRQPGPLPLGLNTKIASFLDPDGWKVLVDHADFLKELH |
| 57 | M.394 | 407 | ILQDNAKIVQIDSSIQARTVGAGSGGFSRLVCLRVHPTFTLLHPTEVVVAFTAINGSRQEVSPESGEVTLEGDLRPNGEWMLVDKCA GVSLVNRFEISQVSKCLVHWGTGDLNMELWSEERPVSKDTPLRICHQYELRQTS |
| 58 | M.329 | 408 | .VRTTDSRCMDLADPCSEYFVEAYLNNPLVQKAIHANTALNYPWTGCRTRTYNLRRFGDSPPSMLAHIKALVTTGIRIWLYSGELYA MVPVTASKHSWKKLRLEVVKDMRPW |
| 58 | M.330 | 409 | .DLADPCSEYFVEAYLNNPLVQKAIHANTALNYPWTGCRTRTYNLRRFGDSPPSMLPHLKALVTTGIRIWLYSGELYA MVPVTASKHSVEKLRLEVVKDMRPWSTAPGQDV |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 58 | M.345 | 410 | ..........NPLVQKAIHANTALNYPWTGCRTRTYNLRRFGASPPSMLAHIKALVTTASASGCTAATWTR |
| 58 | M.323 | 411 | WCP ..........NPLVQKAIHANTALNYPWTGCRTRTYNLRRFGASPPSMLAHIKALVTTASASGCTAATWTR |
| 58 | M.316 | 412 | ..........NNPLVQKAIHANTALNYPWTGCRTRTYNLRRFGDSPPSMLAHIKALVTTGIRIWLYSGDLDA |
| 58 | M.130 | 413 | WCP ..........MVPVTASKHSVEKLRLEVVKDMRPWSTAPGQDVGGYVIEYKGLV |
| 58 | M.131 | 414 | ..........NNPLVQKAIHANTALNYPWTGCRTRTYNLRRFGDSPPSMLAHIKALVTTGIRSPLYSQMRMR |
| 58 | M.203 | 415 | WCP ..........NNPLVQKAIHANTALNYPWTGCRTRTYNLRRFGDSPPSMLAHIKALVTTGIRSPLYSQMRMR |
| 58 | M.227 | 416 | KVRTTDSRCMDLADPCSEYFVEAYLNNPLVQKAIHANTALNYPWTGCRTRTYNLRRFGDSPPSMLAHIKALVTTGI |
| 58 | M.128 | 417 | ..........AIHANTALNYPWTGCRTRTYNLRRFGDSPPSMLAHIKVLVTTGIRIWLYSGDLDA |
| 58 | M.70 | 418 | MVPVTASKHSVEKLRLEVVKDMRP |
| 58 | M.292 | 419 | ..........KAIHANTALNYPWTGCRTRTYNLRRFGDSPPSMLAHIKVLVTTGIRIWLYSGDLDA |
| 58 | M.526 | 420 | MVPVTASKHS |
| 58 | | | ..........QKAIHANTALNYPWTGCRTRTYNLRRFGDSPPSMLAHIKALVTTGIRIWLYSGDLGA |
| 58 | | | MVPVTASKHSVEKLRLEVVKDMRPWSTAPGQDVGGYVIEYK |
| 58 | | | ..........QKAIHANTALNYPWTGCRTRTYNLRRFGDSPPSMLAHIKALVTTGIRIWLYSGDLGA |
| 58 | | | MV |
| 59 | | | ..........ACIGETLEQREAGTTMEVVAAQ ASLKPEFVDIIKSATVKSSSA |
| 59 | M.585 | 421 | ..........PHTASDSPHRADQPMAPRKFFVGGNWKCNGASDDVKKIATVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 59 | M.681 | 422 | ..........PHTASDSPHRADQPMAPRKFFVGGNWKCNGASDDVKKIATVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 59 | M.685 | 423 | RPHTASDSPHRADQPMAPRKFFVGGNWKCNGTSDDVKKIVTVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 59 | M.596 | 424 | ..........................MAPRKFFVGNWKCNGTSDDVKKIVTVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 59 | M.660 | 425 | ..........................MQNGTSDDVKKIVTVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 59 | M.674 | 426 | RPHTASDSPHRADQPMAPRKFFCGGNWKCNGASDDVKKIVTVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 59 | M.703 | 427 | .......PHTASDSPHRADQPMAPRKFFVGGNWKCNGASDDVKKIVTVLNEAEVPSEDAVEVVSPPFVFLQQAKALLRPDF AVAAQNCWVRKGGAFTGEISAEMLVNLQVPWVILGHSERRALLSESNDFVADKVAYALAQGLKVIACIGETLEQREAGTTMEVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 59 | M.504 | 428 | ..........................VVSPPFVFLQQAKALLRPDF AVAGQNCWVRKGGAFTGEISAEMLVNLQVPWVILGHSERRALLSESNDFVADKVAYALAQGLKVIACIGETLEQREAGTTMEVAAQ TKAIAEKISDWTNVVLAYEPVWAIGTFKVASRAQAQEVHDGLRKWLHANVGPAVAESTRIIYGGSVNGANCKELAAQPDLDGFLVGG ASLKPEFVDIIKSATVKSSSA |
| 60 | M.515 | 429 | ..........................GGTVTREPGPVKGGKSVI AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPDGWKSVFVDNLDFLKELEE |
| 60 | M.521 | 430 | ..........................I AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPDGWKSVFVDNLDFLKELEE |
| 60 | M.493 | 431 | ..........................I AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPDGWKSVFVDNLDFLKELEE |
| 60 | M.497 | 432 | ..........................I AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPDGWKSVFVDNLDFLKELEE |
| 60 | M.509 | 433 | LGMKLLRKRDIPEERYTNAFLGYGPEDSHFVELTYNYGVESYDIGSSGFGHFGIAVEDVEKTVELIKAKGGTVTREPGPVKGGKSVI AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPAIWICAGS |
| 60 | M.533 | 434 | ..........................FGIAVEDVEKTVELIKAKGGTVTREPGPVKGGKSVI AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPDGWKSVFVDNLDFLKELEE |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 60 | M.484 | 435 | .........................................................FGIAVEDVEKTVELIKAKGGTVTREPGPVKGGKSVI AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQIAIGTDDVYKTAEVVRQNGGQITREPGPLPGISTKITACTDPDGWKSVFVDNLDFLKELEE |
| 60 | M.302 | 436 | .........................................................................KSVI AFIEDPDGYKFELIERGPTPEPLCQVMLRVGDLDRAIKFYEKAFGMELLRRKDNPQYKYTIAMMGYGPEDKNAVLELTYNYGVKEYD KGNAYAQVDI |
| 61 | M.478 | 437 | LQSKNCILYLCSIMICNCKVSKVLNTYIFLLYLEHT |
| 62 | M.222 | 438 | ...........................................................QSKQMANPTTAAGVLRIFFHDCF VSGCDASVLIAPTHYAKSEKDADINHSLPGDAFDAVVRSKLALELECPGVVSCADI |
| 62 | M.691 | 439 | PKSHTRVGSTYQPAAMRRLSLILLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTVGRIIELFTAKGFTVQEMVALSGAHTLGFSHCQEFASRIYNRDKGKPAPFDPSMNPTYAKGLQAACQDYQKD PTIAAFNDIMTPGKFDNIYSVNIERGLGLLSTDEDMWSDMRTKPFVQRYAANNTDFFEDFAKAIEKLSMYGKTGADGEIRRRCDAF NSGPNIQ |
| 62 | M.510 | 440 | ......................MRRLSLLLLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTV |
| 62 | M.119 | 441 | VSGCDASVLIAPTHYAKSEKDADINHSLPGDAFDAVVRSKLALELECPGVV............................AAGVLRVFFHDCF |
| 62 | M.535 | 442 | PKSHTRVGSTYQPAAMRRLSLILLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTVGRIIELFTAKGFTVQEMVALSGAHTL |
| 62 | M.543 | 443 | PKSHTRVGSTYQPAAMRRLSLILLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTVGRIIELFTAKGFTVQEMVALSGAHTL |
| 62 | M.528 | 444 | PKSHTRVGSTYQPAAMRRLSLILLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTVGRIIELFTAKGFTVQEMVALSGAHT |
| 62 | M.529 | 445 | PKSHTRVGSTYQPAAMRRLSLILLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTVGRIIELFTAKGFTVQEMVALSGAHTLG |
| 62 | M.373 | 446 | ...........................................................................FFHDCF VSGCDASVLIAPTHYAKSEKDADINHSLPGDAFDAVVRSKLALELECPGVVSCADILAIASRVLVTMTGGPRYPVPLGRKDSLSSNP AAPDVELPHSNFTVGRIIELFTAKGFTVQEMVALSGAHTLG |
| 62 | M.590 | 447 | PKSHTRVGSTYQPAAMRRLSLILLAAAALLAAAVSAEPGPAPKLSPDFYSQTCPRAERIIAEVVQSKQMANPTTAAGVLRVFFHDCF VSGCDASVLIAPTHYAKSEKDADINHSLPGDAFDAVVRSKLALELECPGVVSCADILAIASRVLVTMTGGPRYPVPLGRKDSLSSNP |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 63 | M.361 | 448 | AAPDVELPHSNFTVGRIIELFTAKGFTVQEMVALSGAHTLGFSHCQEFASRIYNYRDKGGKPAPFDPSMNPTYAKGLQAACQDYQKD PTIAAFNDIMSSSVLSSP |
| 63 | M.432 | 449 | .....PHMLLILLLHGANAALDEPVQKWQTLDGSPPLVIARGGFSGLFPESSLYAYQFAMSNGLPDVVLHCDLQLSSDGKFCRSG LRLDKSTLIAEVFPKRDKTYKLGTEDIHGWFAVDFTAAELVNNVT |
| 63 | M.477 | 450 | MGGRYPHMLLILLLHGANAALDEPVQKWQTLDGSPPLVIARGGFSGLFPESSLYAYQFAMSNGLPDVVLHCDLQLSSDGKFCRSG LRLDKSTLIAEVFPKRDKTYKLGTEDIHGWFAVDFTAAELVNNVT |
| 63 | M.408 | 451 | MGGRYPHMLLILLLHGANAALDEPVQKWQTLDGSPPLVIARGGFSGLFPESSLYAYQFAMSNGLPDVVLHCDLQLSSDGKFCRSG LRLDKSTLIAEVFPKRDKTYKLGTEDIHGWFAVDFTAAELVNNVTCMHPKLSNLL |
| 63 | M.568 | 452 | .HAANAGLGMLEPIKEEIPTISYSDLYQLAGVVAVEVSGGPVIPFHPGREDKPQPPPEGRLPDATKGSDHLRQVFGKQMGLSDQDIV ALSGGHTLGRCHKERSGFEEGPWTKNPLKFDNTYFTELLSGDKEGLIQLPSDKTLLTDPVFRPLVEKYAADEKAFFEDYKEAHLRLSE LGYAEA |
| 64 | M.589 | 453 | AHAANAGLGMLEPIKEEIPTISYSDLYQLAGVVAVEVSGGPVIPFHPGREDKPQPPPEGRLPDATKGSDHLRQVFGKQMGLSDQDIV ALSGGHTLGRCHKERSGFEEGPWTKNPLKFDNTYFTELLSGDKEGLIQLPSDKTLLTDPVFRPLVEKYAADEKAFFEDYKEAHLRLSE LGYAEA |
| 64 | M.462 | 454 | ...GGHTLGRCHKERSGFEEGPWTKNPLKFDNTYFTELLSGDKEGLIQLPSDKTLLTDPVFRPLVEKYAADEKAFFEDYKEAHLRLSE LGYAEA |
| 64 | M.516 | 455 | ...........HLQDKPQPPPEGRLPDATKGSDHLRQVFGKQMGLSDQDIV ALSGGHTLGRCHKERSGFEEGPWTKNPLKFDNTYFTELLSGDKEGLIQLPSDKTLLTDPVFRPLVEKYAADEKAFFEDYKEAHLRLSE LGYAEA |
| 64 | M.522 | 456 | ..................................PQEGVDHLRQVFGKQMGLSDQDIV ALSGGHTLGRCHKERSGFEEGPWTKNPLKFDNTYFTELLSGDKEGLIQLPSDKTLLTDPVFRPLVEKYAADEKAFFEDYKEAHLRLSE LGYAEA |
| 64 | M.412 | 457 | ..................................PQEGVDHLRQVFGKQMGLSDQDIV ALSGGHTLGRCHKERSGFEEGPWTKNPLKFDNTYFTELLSGDKEGLIQLPSDKTLLTDPVFRPLVEKYAADEKAFFEDYKEAHLRLSE LGYAEA |
| 64 | M.4 | 458 | .............................RVQVVGPDGKRVLETRIEGGSLFIVPRFHVVSKIADASGMEW |
| 65 | M.256 | 459 | KEVGLGADLVRIDAHSMCSPGFSCDSAYQVTYIVRGSGRVQVVGPDGKRVLETRIEGGSLFIVPRFHVVSKIADASGMEWFSII |
| 65 | M.56 | 460 | NPIFSHLA |
| 65 | M.55 | 461 | .............................RVQVVGPDGKRVLETRIEGGSLFIVPRFHVVSKIADASGMEWFSIITTP |
| 65 | M.64 | 462 | ...................YIVRGSGRVQVVGPDGKRVLETRIEGGSLFIVPRFHVVSKIADASGMEWFSIITTP |
| 65 | | | ..............YQVTYIVRGSGRVQVVGPDGKRVLETRIEGGSLFIVPRFHVVSKIADASGMEWFSIIT |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 65 | M.22 | 463 | ............GSGRVQVVGPDGKRVLETRIEGGSLFIVPRFHVVSKIADASGMEWFSIIT |
| 65 | M.148 | 464 | NPI ............CDSAYQVTYIVRGSGRVQVVGPDGKRVLETRIEGGSLFIVPRFHVVSKIADASGMEWFSIITTP |
| 65 | M.205 | 465 | NPI ............SMCSPGFSCDSAYQVTYIVRGSGRVQVVGPDGKRVLETRIEGGSLFIVPRFHVVSKIADASGMEWFSIITTP |
| 65 | M.332 | 466 | ............PGFSCDSAYQVTYIVRGSGRVQVVGPDGKRVLETRIEGGSLFIVPRFHVVSKIADASGMEWFSIITTP NPIFSHLAGKTSVWKAISPEVLEASFNTTPEMEKLFRSKRLDSEI |
| 65 | M.171 | 467 | ............IDAHSMCSPGFSCDSAYQVTYIVRGSGRVQVVGPDGKRVLETRIEGGSLFIVPRFHVVSKIADASGMEWF |
| 66 | ME.3566 | 468 | PPRSCRGRCPCSLRTPAWGSCSRMAPCNCRCPCSTRGARRRLPGRTSS |
| 67 | ME.4276 | 469 | ATSPTTRTTAPTSRRSPSAPSPHTSPPPRASATTSSRDGTTRTCISTRRIPSRPTTSPWSTCRAARSPTPSATSASREPTPRPSRSS ATSSRRSLDRREIWLSEMVAWVGLQLAFWIQMQH |
| 67 | ME.4056 | 470 | ..SPTTRTTAPTSRRSPSAPSPHTSPPPRASATTSSRDGTTRTCISTRRIPSRPTTSPWSTCRAARSPTPSATSASREPTPRPSRSS ATSSRRSLDRREIWLSEMVAWVGLQLAFWIQMQH |
| 68 | ME.3805 | 471 | SSCSRRCPWRPPRRWSCCPLPWPGTRRWFRCHQPPSSRTAPGSSRSLYGSPSTSC |
| 68 | ME.3720 | 472 | SSCSRRCPWRPPRRWSCCPLPWPGTRRWFRCHQPPSSRTAPGSSRSLYGSPSTSC |
| 69 | ME.3916 | 473 | VKVAPAALVNVLEARSALTISVLRISSMPFSVYHSCKFSPPLPTQVWNPGSLAAFWGKRYPLLSAGRSYGATDSLEMMASSPGWTP CLANSLA |
| 70 | ME.3855 | 474 | SSPSCAPESTHAVRALPSTHTARILLRSTTANVSGCKDRYERPS |
| 71 | ME.1412 | 475 | QVQVPGGHQGDLPRGEGVQPQLPGAAGEVCRRRRRRGGGHQGEGQGQVDRAQGVVGSHLEDRHSQAHRPLHRPLH |
| 72 | ME.4234 | 476 | FAAISNAKHLIYTVTGWSVYTEITLLRRDANRPKPAGGTVTLGELLLKKASEGVRVLMLVWDDRTSVGLKKDGLMATHDEETMNYFQD TDVHCVLCPRDPDDSGSIVQDLQISTMFTHHQKIVVVDHDMPQPQSASRRRRIMSFVGGLDLCDGRYDTPFHSVFGTLDGAHHDDFH QPNFATSAITKGGPREPWHDIHCRLEGPVAWDVLYNFEWRWRKQGGKDLLIQLRDLADEIIPPSPVVYAEDREAWNVQLFRSIDGGA AFGPDTPEDAARAGLVSGKDQIIDRSIQDAYICTIRRAKSFIYIENQYFLGSSYCWKPDGIKPDDVGALHLIPKELSMKVVSKIEA GERFTVYVVVPMWPEGIPASGSVQAILDWQRRTMEMMYTDIAWAIQAKGIDANPKDYLTFFCLGNREAKKAGEYEPPEPAEPDSDYL KAQQNRRFMIVHTKMMIVDDEYIIVGSANINQRSMDGARDSEIAMGAYQPYHLAASRPARGQVHGFRMALWYEHLGMVDEAFQRPE SVECVRKVNAMADRYWNLYAGDGPERDLPGHLLTYPVGVTSDGTVTQLPGVEFFPDTQARILGAKSDYLPILTT |
| 72 | ME.408 | 477 | ...........................................................................H QPNFATAAITKGGPREPWHDIHCRLEGPVAWDVLYNFEWRWRKQGGKDLLIQLRDLADEIIPPSPVVYAEDREAWNVQLFRSIDGGA AFGFPDTPEDAARAGLVSGKDQIIDRSIQDAYICTIRRAKSFIYIENQYFLGSSYCWKPDGIKPDDVGALHLIPKELSMKVVSKIEA GERFTVYVVVPMWPEGIPASGSVQAILDWQRRTMEMMYTDIAWAIQAKGIDANPKDYLTFFCLGNREAKKAGEYEPPEPAEPDSDYL KAQQNRRFMIVHTKMMIVDDEYIIVGSANINQRSMDGARDSEIAMGAYQPYHLAASRPARGQVHGFRMALWYEHLGMVDEAFQRPE SVECVRKVNAMADRYWNLYAGDGPERDLPGHLLTYPVGVTSDGTVTQLPGVEFFPDTQARILGAKSDYLPPILTT |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 72 | ME.4115 | 478 | ...........................QSASRRRR.IMSFVGGLDLCDGRYDTPHSVFGTLDGAHHDDFH QPNFATSAITKGGPREPWHDIHCRLEGPVAWDVLYNFEWRWRKQGGKDLLIQLRDLADEIIPPSPVVYAEDREAWNVQLFRSIDGGA AFGFPDTPEDAARAGLVSGKDQIIDRSIQDAYICTIRRAKSFIYIENQYFLGSSYCWKPDGIKPDDVGALHLIPKELSMKVVSKIEA GERFTVYVVPMWPEGIPASGSVQAILDWQRRTMEMMYTDIAWAIQAKGIDANPKDYLTFFCLGNREAKKAGEYEPPEAEPDSDYL KAQQNRRFMIYVHTKMMIVDDEYIIVGSANINQRSMDGARDSEIAMGAYQPYHLAASRPARGQVHGFRMALWYEHLGMVDEAFQRPE SVECVRKVNAMADRYWNLYAGDGPERDLPGHLLTPVGVTSDGTVTQLPGVEFFPDTQARILGAKSDYLPILTT |
| 72 | ME.4210 | 479 | ...........................SEGVRVLMLVWDDRTSVGVLKKDGLMATHDEETMNYFQD TDVHCVLCPRDPDDSGSIVQDLQISTMFTHHQKIVVVDHDMPQPQSASRRRRIMSFVGGLDLCDGRYDTPHSVFGTLDGAHHDDFH QPNFATAAITKGGPREPWHDIHCRLEGPVAWDVLYNFEWRWRKQGGKDLLIQLRDLADEIIPPSPVLYAEDREAWNVQLFRSIDGGA AFGFPDTPEDAARAGLVSGKDQIIDRSIQDAYICTIRRAKSFIYIENQYFLGSSYCWKPDGIKPDDVGALHLIPKELSMKVVSKIEA GERFTVYVVPMWPEGIPASGSVQAILDWQRRTMEMMYTDIAWAIQAKGIDANPKDYLTFFCLGNREAKKAGEYEPPEAEPDSDYL KAQQNRRFMIYVHTKMMIVDDEYIIVGSANINQRSMDGARDSEIAMGAYQPYHLAASRPARGQVHGFRMALWYEHLGMVDEAFQRPE SVECVRKVNAMADRYWNLYAGDGPERDLPGHLLTPVGVTSDGTVTQLPGVEFFPDTQARILGAKSDYLPILTT |
| 72 | ME.3897 | 480 | ...........................TDVHCVLCPRDPDDSGSIVQDLQISTMFTHHQKIVVVDHDMPQPQSASRRRRIMSFVGGLDLCDGRYDTPHSVFGTLDGAHHDDFH QPNFATAAITKGGPREPWHDIHCRLEGPVAWDVLYNFEWRWRKQGGKDLLIQLRDLADEIIPPSPVVYAEDREAWNVQLFRSIDGGA AFGFPDTPEDAARAGLVSGKDQIIDRSIQDAYICTIRRAKSFIYIENQYFLGSSYCWKPDGIKPDDVGALHLIPKELSMKVVSKIEA GERFTVYVVPMWPEGIPASGSVQAILDWQRRTMEMMYTDIAWAIQAKGIDANPKDYLTFFCLGNREAKKAGEYEPPEAEPDSDYL KAQQNRRFMIYVHTKMMIVDDEYIIVGSANINQRSM |
| 73 | ME.4229 | 481 | ...........................PLLEGSGKLEVWCVDGSAKTALPKEDLGKFHSGDCYIVLYTYHSGEKREEFYLITYWIGKDSVLEDQHMALQIATTIWNSMK GRPVLGRIYQGKEPPQFIALFQPMVILKGGISSGYKKSIEENGLKDETYSCTGIALVHHGTSIHNNKTLQVDAVSISLSSTDCFVL QSGNSMFTWIGNTSSYEQQQWAAKVAEFLKPGASVKHCKEGTESSAFWSALGGKQNYTSKNATQDVLREPHLYTFSFRNGKLEVTEV FNFSQDDLLTEDVMILDTHAEVFVWMGQCVDTKEKQTAFETGQKVEHAVNFEGLSPDVPLYKVSEGNEPCFFRTYFSWDNTRSVIH GNSFQKKLSLLFGMRSESGSKGSGDGGPTQRASALAALSSAFNPSSQDKQSNDRPKSSGDGGPTQRASALAALSSSLNPSSKPKSPH SQSRSQGSQGRAAAVAALSNVLTAEGSTLSPRNDAEKTELAPSEFHTDQDAPGDEVPSEGERTEPDVSQEETANENGGETTFSYDRL ISKSTDPVRGIDYKRRETYLSDSEFETVFGVTKGGILPAAKVEARIAEKKSRSFLKHSLLRTQRLHKFLVCSSMIGVMAHQKPMSGN LVMFQMQDHQLIYPLISPSFLVYSFFVHDLR |
| 73 | ME.4231 | 482 | ...........................PLLEGSGKLEVWCVDGSAKTALPKEDLGKFHSGDCYIVLYTYHSGEKREEFYLITYWIGKDSVLEDQHMALQIATTIWNSMK GRPVLGRIYQGKEPPQFIALFQPMVILKGGISSGYKKSIEENGLKDETYSCTGIALVHHGTSIHNNKTLQVDAVSISLSSTDCFVL QSGNSMFTWIGNTSSYEQQQWAAKVAEFLKPGASVKHCKEGTESSAFWSALGGKQNYTSKNATQDVLREPHLYTFSFRNGKLEVTEV FNFSQDDLLTEDVMILDTHAEVFVWMGQCVDTKEKQTAFETGQKVEHAVNFEGLSPDVPLYKVSEGNEPCFFRTYFSWDNTRSVIH GNSFQKKLSLLFGMRSESGSKGSGDGGPTQRASALAALSSAFNPSSQDKQSNDRPKSSGDGGPTQRASALAALSSSLNPSSKPKSPH SQSRSQGSQGQRAAAVAALSNVLTAEGSTLSPRNDAEKTELAPSEFHTDQDAPGDEVPSEGERTEPDVSQEETANENGGETTFSYDRL ISKSTDPVRGIDYKRRETYLSDSEFETVFGVTKEEFVGTKEEFYQQPRWKQELQKRKADLF |
| 73 | ME.4280 | 483 | VGRVTQVDDRKAASAAVEEFIVKQNRPKTTRVTQVIQGYENHTFKSLFESWPVSSTGNASTEEGRGKVAALLKKKGDVKGASKNSTP VNEEVPLLEGSGKLEVWCVDGSAKTALPKEDLGKFHSGDCYIVLYTYHSGEKREEFYLITYWIGKDSVLEDQHMALQIATTIWNSMK GRPVLGRIYQGKEPPQFIALFQPMVILKGGISSGYKKSIEENGLKDETYSCTGIALVHHGTSIHNNKTLQVDAVSISLSSTDCFVL QSGNSMFTWIGNTSSYEQQQWAAKVAEFLKPGASVKHCKEGTESSAFWSALGGKQNYTSKNATQDVLREPHLYTFSFRNGKLEVTEV |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 73 | ME.4281 | 484 | FNFSQDDLLTEDVMILDTHAEVFVWMGQCVDTKEKQTAFETGQKVVEHAVNFEGLSPDVPLYKVSEGNEPCFFRTYFSWDNTRSVIH GNSFQKKLSLLFGMRSESGSKGSGDGGPTQRASALAALSSAFNPSSQDKQSNDRPKSSGDGGPTQRASALAALSSSLNPSSKPKSPH SQSRSGQGSQRAAAVAALSNVLTAEGSTLSPRNDAEKTELAPSEFHTDQDAPGDEVPSEGERTEPDVSQEETANENGGETTFSYDRL ISKSTDPVRGIDYKRRETYLSDSEFETVFGVTKEEFYQQPRWKQELQKRKADLF VGRVTQVDDRKAASAAVEEFIVKQNRPKTTRVTQVIQGYENHTFKSLFESWPVSSTGNASTEEGRGKVAALLKKKGDVKGASKNSTP VNEEVPPLLEGSGKLEVWCVDGSAKTALPKEDLGKFHSGDCYIVLYTYHSGEKREEFYLTYWIGKDSVLEDQHMALQIATTIWNSMK GRPVLGRIYQGKEPPQFIALFQPMVILKGGISSGYKKSIEENGLKDETYSGTGIALVHIHGTSIHNNKTLQVDAVSISLSSTDCFVL QSGNSMFTWIGNTSSYEQQQWAAKVAEFLKPGASVHCKEGTESSAFWSALGGKQNYTSKNATQDVLREPHLYTFSFRNGKLEVTEV FNFSQDDLLTEDVMILDTHAEVFVWMGQCVDTKEKQTAFETGQKVVEHAVNFEGLSPDVPLYKVSEGNEPCFFRTYFSWDNTRSVIH GNSFQKKLSLLFGMRSESGSKGSGDGGPTQRASALAALSSAFNPSSQDKQSNDRPKSSGDGGPTQRASALAALSSSLNPSSKPKSPH SQSRSGQGSQRAAAVAALSNVLTAEGSTLSPRNDAEKTELAPSEFHTDQDAPGDEVPSEGERTEPDVSQEETANENGGETTFSYDRL ISKSTDPVRGIDYKRRETYLSDSEFETVFGVTKEEFYQQPRWKQELQKRKADLF |
| 73 | ME.1571 | 485 | .......................DYKRRETYLSDSEFQTVFGVTKEEFYQQPRMKQELQKRKADLF |
| 73 | ME.4190 | 486 | .........................................................LEDQHMALQIATTIWNSMK GRPVLGRIYQGKEPPQFIALFQPMVILKGGISSGYKKSIEENGLKDETYSGTGIALVHIHGTSIHNNKTLQVDAVSISLSSTDCFVL QSGNSMFTWIGNTSSYEQQQWAAKVAEFLKPGASVHCKEGTESSAFWSALGGKQNYTSKNATQDVLREPHLYTFSFRNGKLEVTEV FNFSQDDLLTEDVMILDTHAEVFVWMGQCVDTKEKQTAFETGQKVVEHAVNFEGLSPDVPLYKVSEGNEPCFFRTYFSWDNTRSVIH GNSFQKKLSLLFGMRSESGSKGSGDGGPTQRASALAALSSAFNPSSQDKQSNDRPKSSGDGGPTQRASALAALSSSLNPSSKPKSPH SQSRSGQGSQRAAAVAALSNVLTAEGSTLSPRNDAEKTELAPSEFHTDQDAPGDEVPSEGERTEPDVSQEETANENGGETTFSYDRL ISKSTDPVRGIDYKRRETYLSDSEFETVFGVTKEEFYQQPRWKQELQKRKADLF |
| 74 | ME.4230 | 487 | ITNAERLIYQTANSRLCSVLPKEEFYQQPRMKQELQKRKADLF |
| 75 | ME.3882 | 488 | ATGAAAAMTTTIRSTATARPPAIV |
| 76 | MN.82 | 489 | ..............................................RVRREYKANEISE |
| 76 | MN.124 | 490 | IAIAFLSVSNNYEYILSDKLVVSTCCSLMHTAVDLVNETKLDSEIKSWLAFAAQKVVEVNALGKALVGLKD EAYFAANAAAQASRSSSPRVNNEEVQKAAAALKGSDHRRATTVSARLDAQQKKLNLPVLPTTIGSFPQTMDLRRVRREYKAKKISE EAYVSAIKEEISKVVKIQEELDIDVLVHGEPER |
| 76 | MN.169 | 491 | YLFAGVVDGRNIWADDLAASLSTLESLEAIVGKDKLVVSTCCSLMHTAVDLVNETKLDESIKSWLAFAAQKVVEVNALGKALVGLKD EAYFAANAAAQASRSSSPRVNNEEVQKAAAALKGSDHRRATTVSARLDAQQKKLNLPVLPTTIGSFPQTMDLRRVRREYKAKKISE EAYVSAIKEEISKVVKIQEELDIDVLVHGEPERNDMVEYFGEQLSGFAFTANGWVQSYGSRCVKPPIIYGDVSRPNPMTVFWSKMAQ SMTPRPM |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 77 | MN.185 | 492 | ..........................................KVRSKILSEEFGWDKDLA<br>KKIWCFGPETTGPNMVVDMCKGVQYLNEIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.140 | 493 | ..........................................EIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.201 | 494 | ..........................................NQPKLVEGLKRLAKSDPMVLCSIEESGEHIIAGAGELHLEICLKD<br>LQDDFMGGAEIIVSPPVVSFRETVLDKSCRTVMSKSPNKHNRLYMEARPLEEGLPEAIDEGRIGPRDDPKVRSKILSEEFGWDKDLA<br>KKIWCFGPETTGPNMVVDMCKGVQYLNEIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.193 | 495 | ..........................................IGPRDDPKVRSKILSEEFGWDKDLA<br>KKIWCFGPETTGPNMVVDMCKGVQYLNEIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.183 | 496 | ..........................................RIGPRDDPKVRSKILSEEFGWDKDLA<br>KKIWCFGPETTGPNMVVDMCKGVQYLNEIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.184 | 497 | ..........................................RIGPRDDPKVRSKILSEEFGWDKDLA<br>KKIWCFGPETTGPNMVVDMCKGVQYLNEIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.173 | 498 | ..........................................ETTGPNMVVDMCKGVQYLNEIKDSVVAGFQWASKEGALADENMRGICFEVCDVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 77 | MN.210 | 499 | DPEGPLMLYVSKMIPASDKGRFFAFGRVFAGRVATGMKVRIMGPNFVPGQKKDLYTKSVQRTVIMGKKQESVEDVPCGNTVALVGL<br>DQFITKNATLTGEKEVDACPIRAMKFSVSPVVRVAVQCKVASDLPKLVEGLKRLAKSDPMVLCSIEESGEHIIAGAGELHLEICLKD<br>LQDDFMGGAEIIVSPPVVSFRETVLDKSCRTVMSKSPNKHNRLYMEARPLEEGLPEAIDEGRIGPRDDPKVRSKILSEEFGWDKDLA<br>KKIWCFGPETTGPNMVVDMCKFGVQYLNEIKDSVVAGFQWASKEGALADENMRGICFEVCDVVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.206 | 500 | DPEGPLMLYVSKMIPASDKGRFFAFGRVFAGRVATGMKVRIMGPNFVPGQKKDLYTKSVQRTVIMGKKQESVEDVPCGNTVALVGL<br>DQFITKNATLTGEKEVDACPIRAMKFSVSPVVRVAVQCKVASDLPKLIVEGLKRLAKSDPMVLCSIEESGEHIIAGAGELHLEICLKD<br>LQDDFMGGAEIIVSPPVVSFRETVLDKSCRTVMSKSPNKHNRLYMEARPLEEGLPEAIDEGRIGPRDDPKVRSKILSEEFGWDKDLA<br>KKIWCFGPETTGPNMVVDMCKFGVQYLNEIKDSVVAGFQWASKEGALADENMRGICFEVCDVVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 77 | MN.136 | 501 | .................................................................................................<br>.................................................................................................<br>.................................................................AGFQWASKEGALADENMRGICFEVCDVVLHTDAIHRGGGQVIPTARRVIFASQ<br>LTAKPRLLEPVYLVEIQAPEGALGGIYGVLNQKRGHVFEEMQRPGTPLYNIKAYLPVIESFGFSATLRAATSGQAFPQCVFDHWDVM<br>NSDPLEVDSQSFNLVKEIRKRKGLKEQMTPLSDFEDKL |
| 78 | MN.94 | 502 | RHLARQFIPHLHQRFIHPPIHQPNTMENLSSTIFSFVILLSASASLVVAGDPIKEACGGTRFPETCASVLSANKDPRSTYADPGELA<br>EMEVSAAFHLFSMAVTTRSQQWNDEN |
| 78 | MN.83 | 503 | RHLARQFIPHLHQRFIHPPIHQPNTMENLSSTIFSFVILLSASASLVVAGDPIKEACGGTRFPETCASVLSANKDPRSTYADPGELA<br>EMEVS |
| 78 | MN.14 | 504 | ..................................PNTMENLSSTIFSFVILLSASASLVVAGDPIKEACGGTRFPETCASVLSANKDPR |
| 78 | MN.3 | 505 | ..................................................................................YYGKINLSKVRTFLTEAKAKHIEWNCDVCRRGDDK<br>KKVDEISKG |
| 78 | MN.46 | 506 | .PHVARIRPHLHQRFIHPPIHQPNTMENLSSTIFSFVILLSASASLVVAGDPIKEACGGTRFPETCASVLSANKDPR |
| 78 | MN.17 | 507 | ..........................MENLSSTIFSFVILLSASASLVVAGDPIKEACGGTRFPETCASVLSANKDPRSAVD |
| 78 | MN.20 | 508 | ..........................MENLSSTIFSFVILLSASASLVVAGDPIKEACGGTRFPETCASVLSANKDPRSTYADP |
| 78 | MN.12 | 509 | ..................................FTPHSLKLHKACEAFNPYDGKISLSKVRSFLTEAKAKHIEWNCDVCRHGDDK<br>KK |
| 78 | MN.35 | 510 | ..................................QQWNDENMSKEDEDCFKECGVKLHKACEAFNPYDGKISLSKVRSFLTEAKAKHIEWNCDVCRHGDDK<br>KK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 78 | MN.15 | 511 | ..........FTPHSLKLHKACEAFDPYYGKISLSKVRSFLTEAKAKHIEWNCDVCRHGDDK KKV |
| 78 | MN.38 | 512 | ..........QQWNDENMSKEDEDCFKECGVKLHKACEAFDPYYGKISLSKVRSFLTEAKAKHIEWNCDVCRHGDDK KKV |
| 78 | MN.74 | 513 | ..........NTMENLSSTIFSFVILLSASASLVVAGDQIKEACGGTRFPETCASVLSANKDPRSTYADPVELA EMEVSAAFHLFSMAVTAARSQQWNDEN |
| 78 | MN.41 | 514 | ..........SQQWNDENMSKEDEDCFKECGVKLHKACEAFDPYDGKISLSKVRSFLTEAKAKHIEWNCDVCRHGDDK KKVD |
| 78 | MN.67 | 515 | ..........MENLSSTIFSFVILLSASASLVVAGDQIKEACGGTRFPETCASVLSANKDPRSTYADPVELA EMEVSAAFHLFSMAVTAARSQQWNDEN |
| 78 | MN.27 | 516 | ..........QQWNDENMSKEDEDCFKECGVKLHKACEAFDPYYGKISLSKVRSFLTEAKAKHIEWNCDVCR |
| 78 | MN.75 | 517 | ..........LLSASASLVVAGDPIKEACGGTRFPETCASVLSANKDPRSTYADPGELA EMECGTDFHLFSMTVTAAGSQQWNDENMSKEDEDCFKECGVKL |
| 78 | MN.47 | 518 | ..........GSQQWNDENMSKEDEDCFKECGVKLHKACDAFNPYYGKTNLSKVRTFLTEAKAKHIEWNCDVCRHGDDK KTVDEISK |
| 78 | MN.33 | 519 | ..........DGGREILHQPNTMENLSSTIFSFVILLSASASLVVAGDPIKEACGGTRYPETCVSVLSANKDPRST |
| 78 | MN.86 | 520 | ..........IKEACGTRFPETCASVLSANKDPRSTYADPVELA EMEVSAAFHLFSMAVTAARSQQWNDENMSKEKRWNAALTSISASSTGSAVVDLGSLLAERTEACASGKRVPPHASLI |
| 78 | MN.59 | 521 | ..........IKEACGGTRFPETCASVLSANKDPRSTYADPVELA EMEVSAAFHLFSMAVTAARSQQWNDENMSKEDEDCFKECGVKLHTLDR |
| 78 | MN.63 | 522 | ..........IKEACGGTRFPETCASVLSANKDPRSTYADPVELA EMEVSAAFHLFSMAVTAARSQQWNDENMSKEDEDCFKECGVKLHKACEAFNP |
| 78 | MN.8 | 523 | ..........STIFSFVILLSASASLVVAGDPIKEACGGPRFPETCASVLSANKDPRSTYA |
| 78 | MN.51 | 524 | ..........IKEACGGTRFPETCASVLSANKDPRSTYADPVELA EMEVSAAFHLFSMAVTAARSQQWNDENMSKEDEDCFKECGVKL |
| 78 | MN.62 | 525 | ..........IKEACGGTRFPETCASVLSANKDPRSTYADPVELA EMEVSAAFHLFSMAVTAARSQQWNDENMSKEDEDCFKECGMKLHKACEAFNP |
| 78 | MN.56 | 526 | ..........IKEACGGTRFPETCASVLSANKDPRSTYADPVELA EMEVSAAFHLFSMAVTAARSQQWNDENMSKEDEDCFKECGLNASHAL |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 78 | MN.30 | 527 | ...........RAAVTTMENLSSTIFSFVILLSASASLVVAGDPIKEACGGTRFPETCASVLSANKDPRSAVDLG |
| 79 | MN.81 | 528 | ..................................................................VKLKNVLNVY |
| 79 | MN.91 | 529 | EARLTKFKYLAGDYLSLADLNHVSTTLCLGATPHASLFDAYPHVKAWTDLLAKPSVQKVAALMKP..........VEDNLVKLKNVLNVY |
| 79 | MN.36 | 530 | EARLTKFKYLAGDYLSLADLNHVSTTLCLGATPHASLFDAYPHVKAWTDLLAKPSVQKVAALMKP..........VEDNLVKLKNVLNVY |
| 79 | MN.71 | 531 | EARLTKFKYLAGDYLSLSLADLNHVSTTLCLGATPHASLFDAYPHVKAWTDLLAKPSVQKVAA...................LKKVLEVY |
| 79 | MN.80 | 532 | ..............................DLNHVSTTLCLGATPHASLFDAYPHVKAWTDLLAKPSVQKVAALMKP..........DNLVKLKNVLNVY |
| 79 | MN.76 | 533 | EARLTKFKYLAGDYLSLADLNHVSTTLCLGATPHASLFDAYPHVKAWTDLLAKPSVQKVAALMKP......................KKVLEVY |
| 79 | MN.96 | 534 | EARLTKFKYLAGDYLSLADLNHVSTTLCLGATPHASLFDAYPHVKAWTDLLAKPSVQKVAALMKP |
| 79 | MN.106 | 535 | ........QYTAALSPILFECLIHPMLGGATNQKVEDNLVKLKNVLNVY |
| 79 | MN.90 | 536 | ........QYTAALSPILFECLIHPMLGGATNQKVIEDNLVKLKNVLNVY |
| 79 | MN.57 | 537 | ........QYTAALSPILFECLIHPMLGGATNQKVEDNLVKLKNVLNVY |
| 79 | MN.25 | 538 | EARLTKFKYLAGDYLSLADLNHVSTTLCLGATPHASLFDAYPHVKAWTDLLAKPSVQKVAALMKP |
| 79 | MN.108 | 539 | ........QYTAALSPILFECLIHPMLGGATNQKVEDNLVKLKNVLNVY |
| 79 | MN.186 | 540 | DGDLCIFESRAICKYACRKNPELLKEGDLKEAAMDEALEENG..............AALEEAGVDYEIVPINFGTGEHKAPDHLARNPFGQVPALQ |
| 79 | | | DGDLCIFESRAICKYACRKNPELLKEGDLKESAMVDVWLEVEANQY.............................DHLARNPFGQVPALQ |
| 79 | | | CIPYRESAGGEVEVLVISSRKKGASAGVLFPKGGWELDETMEEAARREALEEAGVDYEIVPINFGTFEHKGPDHLARNPFGQVPALQ |
| 79 | | | DGDLCIFESRAICKYACRKNPELLKEGDLKESAMVDVWLEVEAQQYTAALSPILFECLVHPMLGGATDQKVEDNLLQ |
| 80 | | | KLRFTCLSSTGSSCLFVLILF |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 81 | MN.58 | 541 | EKLKVLEVYEARLSKHSYLAGDFVSFADLNHFPKTFYFMATPHASLFDSYPHVKAWWERIMARPAVKKIAAAMVPPKA |
| 82 | MN.6 | 542 | .........PDHLARNPFGQVPALQDGDLYIFESRAICKYACRKNKPELLKEGDL |
| 82 | MN.77 | 543 | EHKGPDHLARNPFGQVPALQDGDLYIFESRAICKYACRKNKPELLKEGDLKEAAMVDVWLEVEANQYTAALGPILFE.........LEEAGVDYEIVPINFGTG |
| 82 | MN.107 | 544 | PAPRRLFKPGPPASSSPSHPIHPAATSLPPPRKRVRGFWRVHQISARMAPVKLYGATLSWNVTRCVAALEEAGVDYEIVPINFGTG<br>EHKGPDHLARNPFGQVPALQDGDLYIFESRAICKYACRKNKPELLKEGDLKEAAMVDVWLEVEANQYTAALGPILFE |
| 83 | MN.203 | 545 | .........RLKKLKSEHGKVQLGNITVDMVLGGMRGMTGMLWETSLLDPEEGIRFRGLSIPECQKVLPT<br>AVKGGEPLPEGLLWLLLTGKVPTKEQVDALSKDLLSRSTVPGYVYKAIDALPVTAHPMTQFTTGVMALQVESEFAKAYDKGMPKSKF<br>WEPTYEDCLNLIARLPQVASVYYRRIFKDGKTIAADNSLDYAANFSHMLGFDDPKMLELMRLYITIHTDHEGGNVSAHTGHLVGSAL<br>SDPYLSFAAALNGLAGPLHGLANQEVLLMIKSVMEETGSNITTDQLKEYVWKTLKSGKVVPGYGHGVLRNTDPRYSCQREFALKHLP<br>EDPLFQLVSKLYEVVPGILTELGKVKNPWPNVDAHSGVLLNHFGLVEARYDTVLFGVSRSMGIGSQLIQDRALGLPLERPKSVTMEW<br>LENHCKKVAA |
| 83 | MN.204 | 546 | .........RLKKLKSEHGKVQLGNITVDMVLGGMRGMTGMLWETSLLDPEEGIRFRGLSIPECQKVLPT<br>AVKGGEPLPEGLLWLLLTGKVPTKEQVDALSKDLLSRSTVPGYVYKAIDALPVTAHPMTQFTTGVMALQVESEFAKAYDKGMPKSKF<br>WEPTYEDCLNLIARLPQVASVYYRRIFKDGKTIAADNSLDYAANFSHMLGFDDPKMLELMRLYITIHTDHEGGNVSAHTGHLVGSAL<br>SDPYLSFAAALNGLAGPLHGLANQEVLLMIKSVMEETGSNITTDQLKEYVWKTLKSGKVVPGYGHGVLRNTDPRYSCQREFALKHLP<br>EDPLFQLVSKLYEVVPGILTELGKVKNPWPNVDAHSGVLLNHFGLVEARYDTVLFGVSRSMGIGSQLIQDRALGLPLERPKSVTMEW<br>LGNHCKKVAA |
| 83 | MN.211 | 547 | AYFEACSLFLNYAVSFNYFVCNLLQERLKKLKSEHGKVQLGNITVDMVLGGMRGMTGMLWETSLLDPEEGIRFRGLSIPECQKVLPT<br>AVKGGEPLPEGLLWLLLTGKVPTKEQVDALSKDLLSRSTVPGYVYKAIDALPVTAHPMTQFTTGVMALQVESEFAKAYDKGMPKSKF<br>WEPTYEDCLNLIARLPQVASVYYRRIFKDGKTIAADNSLDYAANFSHMLGFDDPKMLELMRLYITIHTDHEGGNVSAHTGHLVGSAL<br>SDPYLSFAAALNGLAGPLHGLANQEVLLMIKSVMEETGSNITTDQLKEYVWKTLKSGKVVPGYGHGVLRNTDPRYSCQREFALKHLP<br>EDPLFQLVSKLYEVVPGILTELGKVKNPWPNVDAHSGVLLNHFGLVEARYDTVLFGVSRSMGIGSQLIQDRALGLPLERPKSVTMEW<br>LENHCKKVAA |
| 83 | MN.205 | 548 | AYFEACSLFLNYAVSFNYFVCNLLQERLKKLKSEHGKVQLGNITVDMVLGGMRGMTGMLWETSLLDPEEGIRFRGLSIPECQKVLPT<br>AVKGGEPLPEGLLWLLLTGKVPTKEQVDALSKDLLSRSTVPGYVYKAIDALPVTAHPMTQFTTGVMALQVESEFAKAYDKGMPKSKF<br>WEPTYEDCLNLIARLPQVASVYYRRIFKDGKTIAADNSLDYAANFSHMLGFDDPKMLELMRLYITIHTDHEGGNVSAHTGHLVGSAL<br>SDPYLSFAAALNGLAGPLHGLANQEVLLMIKSVMEETGSNITTDQLKEYVWKTLKSGKVVPGYGHGVLRNTDPRYSCQREFALKHLP<br>EDPLFQLVSKLYEVVPGILTELGKVKNPWPNVDAHSGVLLNHFGLVEARYDTVLFGVSRSMGIGSQLIQDRALGLPLERPKSVTMEW<br>LGNHCKKGA |
| 83 | MN.68 | 549 | .........VSKLYEVVPGILTELGKVKNPWPNVDAHSGVLLNHFGLVEARYDTVLFGVSRSMGIGSQLIQDRALGLPLERPKSVTMEW<br>LGNHCKKGA |
| 83 | MN.98 | 550 | ......... |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 83 | MN.93 | 551 | ................................................................TDPRYSCQREFALKHLP EDPLFQLVSKLYEVVPGILTELGKVKNPWPNVDAHSGVLLNHFGLVEARYDTVLFGVSRSMGIGSQLIQDRALGLPLERPKSVTMEW LENHCKKVAA |
| 83 | MN.113 | 552 | ...............VSKLYEVVPGILTELGKVKNPWPNVDAHSGVLLNHFGLVEARYDTVLFGVSRSMGIGSQLIQDRALGLPLERPKSVTMEW LENHCKKVAA |
| 83 | MN.123 | 553 | ...............VSKLYEVVPGILTELGKVKNPWPNVDAHSGVLLNHFGLVEARYDTVLFGVSRSMGIGSQLIQDRALGLPLERPKSVTMEW LENHCKKVAA |
| 83 | MN.69 | 554 | ................................................................TDPRYSCQREFALKHLP EDPLFQLVSKLYEVVPGILTELGKVKNPWPNVDAHSGVLLNHFGLVEARYDTVLFGVSRSMGIGSQLIQDRALGLPLERPKSVTMEW LG |
| 84 | MN.178 | 555 | PRPMKGMLTGPVTILNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVVDIHSPRIPTAEEIADRVNKMLAVLDT NILWVNPDCGLKTRKYAEVMPALTNMVTAAKLIRTQLASTK |
| 84 | MN.182 | 556 | ...KGMLTGPVTILNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVVDIHSPRIPTAEEIADRVNKMLAVLDT NILWVNPDCGLKTRKYAEVMPALTNMVTAAKLIRTQLASTK |
| 84 | MN.4 | 557 | ................................................................VFREGVVYGAGIGPGVVDIHSPRIPSKEEIADRVNKMLAVLDT NI |
| 84 | MN.166 | 558 | ...KGMLTGPVTILNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVVDIHSPRIPTAEEIADRVNKMLAVLDT NILWVNPDCGLKTRKYAEVMPALTNMVTAAKLIRTQLASTK |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 84 | M.167 | 559 | ...MKGMLTGPVTILNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVYDIHSPRIPTAEEIADRVNKMLAVLDT NILWVNPDCGLKTRKYAEVMPALTNMVTAAKLIRTQLASTK |
| 84 | MN.172 | 560 | PRPMKGMLTGPVTILNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVYDIHSPRIPTAEEIADRVNKMLAVLDT NILWVNPDCGLKTRKYAEVMPALTNMVTAAKLIRTQLASTK |
| 84 | MN.168 | 561 | ....LNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVYDIHSPRIPTAEEIADRVNKMLAVLDT NILWVNPDCGLKTRKYAEVMPALTNMVTAAKLIRTQLASTK |
| 84 | MN.105 | 562 | PRPMKGMLTGPVTILNWSFVRNDQPRFETCYQIALAIKKEVEDLEAGGIQVIQIDEAALREGLPLRKSEHAFYLDWAVHSFRITNCG VQDTTQIHTHMCYSNFNDIIHSIINMDADVITIENSRSDEKLLSVFREGVTYGAGIGPGVYDIHSPRIPTAEEI |
| 85 | MN.39 | 563 | LSELRNELGGRGIKDEGLVVAPGQGPEGLTVGNIIAGDRFSMAYDRTPEEILAIVVGTGNPAQAGGFPPQG |
| 86 | MN.194 | 564 | ....MSTAEATREENVYMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAGAERKEAAENTLVAYKSAQDIALADL PTTHPIRLGLALNFSVFPYYEIINSPDRACNLAKQAFDEAIAELDSLGEESYKDSTLIMQLLRDNLTLWTSDNADEGGDEIKEASKPE GEGH |
| 86 | MN.195 | 565 | ....MSTAEATREENVYMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAGAERKEAAENTLVAYKSAQDIALADL PTTHPIRLGLALNFSVFPYYEIINSPDRACNLAKQAFDEAIAELDSLGEESYKDSTLIMQLLRDNLTLWTSDNADEGGDEIKEASKPE GEGH |
| 86 | MN.101 | 566 | ............................................................SIEQKEESRGNE AYVASIKEYRTRIETELSKICDGILKLLDSHLVPSATAAESKVFYLKMKGDYHRYLAEFKAGAERKEAAENTLVAYKSAQDIALADL PTTHPIRLGLALNFSVFPYYEIINSPDRACNLAKQAFDEAIAELDSLGEESYKDSTLIMQ |
| 86 | MN.116 | 567 | ....MSTAEATREENVYMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAGAERKEAAENTLVAYKS |
| 86 | MN.181 | 568 | ....MSTAEATREENVYMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAGAERKEAAENTLVAYKSAQDIALADL PTTHPIRLGLALNFSVFPYYEIINSPDRACNLAKQAFDEAIAELDSLGEESYKDSTLIMQLLRDNLTLWTSDNADEGGDEIKEASKPE GEGH |
| 86 | MN.97 | 569 | ...............................................................RKEAAENTLVAYKSAQDIALADL PTTHPIRLGLALNFSVFPYYEIINSPDRACNLAKQAFDEAIAELDSLGEESYKDSTLIMQLLRDNLTLWTSDNADEGGDEIKEASKPE GEGH |
| 86 | MN.54 | 570 | ...............................FSVFPYYEIINSPDRACNLAKQAFDEAIAELDSLGEESYKDSTLIMQLLRDNLTLWTSDNADEGGDEIKEASKPE ESGDGQ |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 86 | MN.156 | 571 | YMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAGAERKEAAENTLVAYKSAQDIALADL PTTHPIRLGLALNFSVFYYEILNSPDRACNLAKQAFPDEAIAELDSLGEESYKDSTLIMQLLRDNLTLWTSDNADEGGDEIKEASK |
| 86 | MN.117 | 572 | ...YMAKLAEQAERYEEMVEFMEKVAKTADVGELTVEERNLLSVAYKNVIGARRASWRIISSIEQKESRGNE AYVASIKEYRTRIETELSKICDGILKLLDSHLVPSATAAESKVFYLKMKGDYHRYLAEFKA |
| 86 | MN.163 | 573 | ..........................................GAERKEAAENTLVAYKSAQDIALADL PTTHPIRLGLALNFSVFYYEILNSPDRACNLAKQAFPDEAIAELDSLGEESYKDSTLIMQLLRDNLTLWTSDNADEGGDEIKEASKPE GEGH |
| 86 | MN.175 | 574 | ..........................................GAERKEAAENTLVAYKSAQDIALADL PTTHPIRLGLALNFSVFYYEILNSPDRACNLAKQAFPDEAIAELDSLGEESYKDSTLIMQLLRDNLTLWTSDNADEGGDEIKEASKPE GEGH |
| 86 | MN.102 | 575 | MSTAEATREENVYMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAG |
| 86 | MN.202 | 576 | MSTAEATREENVYMAKLAEQAERYEEMVEFMEKVAKTADVGELTVEERNLLSVAYKNVIGARRASWRIISSIEQKEESRGNE AYVASIKEYRTRIETELSKICDGILKLLDSHLVPSATAAESKVFYLKMKGDYHRYLAEFKAGAERKEAAENTLVAYKSAQDIALADL PTTHPIRLGLALNFSVFYYEILNSPDRACNLAKQAFPDEAIAELDSLGEESYKDSTLIMQLLRDNLTLWTSDNADEGGDEIKEASKPE GEGH |
| 87 | MN.157 | 577 | ...................RPSSVLPPDLRSAEAELQPPRRPPMAVKVYVYYSMYGHVGKLAEEIKKGASSVEGVEVKVWQ VHEILAEEVLGKMGAPPKTDVPIISPQELAEADGILFGFPTRFGMMASQMKAFFDATGGLWREQSLAGKPAGVFFSTGTQGGGQETT PLTAVTQLTHHGMVFPVGY TFGAKMFDMEKVQGGSPYGAGTFAGDGSRWPSEMELEHAFHQGKYPAGIAKKLKGSSA |
| 87 | MN.119 | 578 | .PEILSEEVLGKMGAPPKTDVPIISPQELAEADGILFGFPTRFGMMASQMKAFFDATGGLWREQSLAGKPAGVFFSTGTQGGGQETT PLTAVTQLTHHGMVFPVGY TFGAKMFDMEKVQGGSPYGAGTFAGDGSRWPSEMELEHAFHQGKYPAGIAKKLKGSSA |
| 87 | MN.114 | 579 | .PEILSEEVLGKMGAPPKTDVPIISPQELAEADGILFGFPTRFGMMASQMKAFFDATGGLWREQSLAGKPAGVFFSTGTQGGGQETT PLTAVTQLTHHGMVFPVGY TFGAKMFDMEKVQGGSPYGAGTFAGDGSRWPSEMELEHAFHQGKYPAGIAKKLKGSSA |
| 87 | MN.92 | 580 | .....................................VGKLAEEIKKGASSVEGVEVKVWQ VPEILSEEVLGKMGAPPKTDVPIISPQELAEADGILFGFPTRFGMMASQMKAFFDATGGLWREQSLAGKPAGVFFSTGTQGGGQETT PLTAVTQLTHHGMVFPVGY |
| 87 | MN.88 | 581 | ...........................GILFGFPTRFGMMASQMKAFFDATGGLWREQSLAGKPAGVFFSTGTQGGGQETT PLTAVTQLTHHGMVFPVGY TFGAKMFDMEKVQGGSPYGAGTFAGDGSRWPSEMELEHAFH |
| 87 | MN.153 | 582 | QGTATSAGSRALPFLLQLTKQPATRPSSVLPPDLRSAEAELQPPRRPPMAVKVYVYYSMYGHVGKLAEEIKKGASSVEGVEVKVWQ VPEILSEEVLGKMGAPPKTDVPIISPQELAEADGILFGFPTRFGMMASQMKAFFDATGGLWREQSLAGKPAGVFFSTGTQGGGQETT PLTAVTQLTHHGMVFPVGY TFGAKMFDMEKVQGGSPYGAGTFAGDGSRWPSEMELEHAFH |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 87 | MN.95 | 583 | ....................................MAVKVYVYYSMYGHVGKLAEEIKKGASSVEGVEVKVWQ VPEILSEEVLGKMGAPPKTDVPIISPQELAEADGILFGFPTRFGMMASQMKAFFDATGGLWREQSLAGKPAGVFFSTGTQGGQETT PLTAVTQLTHHGMVF |
| 87 | MN.128 | 584 | ...........................................................IKKGASSVEGVEVKVWQ VPEILSEEVLGKMGAPPKTDVPIISPQELAEADGILFGFPTRFGMMASQMKAFFDATGGLWREQSLAGKPAGVFFSTGTQGGQETT PLTAVTQLTHHGMVFVPVGYTFGAKMFDMEKVQGGSPYGAGTFAGDGSRWPSEMELEHAFHQGKYFAGIAKKLKGSSA |
| 87 | MN.122 | 585 | ...........................................................IKKGASSVEGVEVKVWQ VPEILSEEVLGKMGAPPKTDVPIISPQELAEADGILFGFPTRFGMMASQMKAFFDATGGLWREQSLAGKPAGVFFSTGTQGGQETT PLTAVTQLTHHGMVFVPVGYTFGAKMFDMEKVQGGSPYGAGTFAGDGSRWPSEMELEHAFHQGKYFAGIAKKLKGSSA |
| 87 | MN.118 | 586 | ................................................................VEGVEVKVWQ VPEILSEEVLGKMGAPPKTDVPIISPQELAEADGILFGFPTRFGMMASQMKAFFDATGGLWREQSLAGKPAGVFFSTGTQGGQETT PLTAVTQLTHHGMVFVPVGYTFGAKMFDMEKVQGGSPYGAGTFAGDGSRWPSEMELEHAFHQGKYFAGIAKKLKGSSA |
| 87 | MN.99 | 587 | ..................KTDVPIISPQELAEADGILFGFPTRFGMMASQMKAFFDATGGLWREQSLAGKPAGVFFSTGTQGGQETT PLTAVTQLTHHGMVFVPVGYTFGAKMFDMEKVQGGSPYGAGTFAGDGSRWPSEMELEHAFHQGKYFAGIAKKLKGSSA |
| 88 | MN.72 | 588 | ADVYPTVCLPMCVCVLFVTCS |
| 89 | MN.214 | 589 | .............................................GLGRLAACFLDSMATLNLPAWGYGLRYRYGLFKQRIAKEGQBEIAEDMLEKFSPWEIVRHDVVYPVRF FGHVEILPDGRRKSAGGEVLNALAYDVPIPGYKTKNAISLRLWDAKASAEDFNLFQFNDGQYESAAQLHSRAWWICAVLYPGDATEE GKLLRLKQQFFLCSASLQDIIFRFKERKSDRVSGKWSEFPSKVAVQMNDTHPTLAIPELMRLLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNIIGAVYRYKKLKEMSAEEKQKVTPRTVMVGGKAFATYTNAKRIVKLVNDVGAVVNND PDVNKYLKVVFIPNYNNVSVAEVLIPGSELSQHISTAGMEASGTSNMKFSLNGCVIIGTLDGANVEIREEVGEDNFFLFGAKADQVAG LRKDRENGLFKPDPRFEEAKQYIRSGTFGTYDYTPLLDSLEGNSGFPGRGDYFLVGYDFPSYIDAQARVDEAY |
| 89 | MN.219 | 590 | .............................................GLGRLAACFLDSMATLNLPAWGYGLRYRYGLFKQRIAKEGQBEIAEDMLEKFSPWEIVRHDVVYPVRF FGHVEILPDGRRKSAGGEVLNALAYDVPIPGYKTKNAISLRLWDAKASAEDFNLFQFNDGQYESAAQLHSRAWWICAVLYPGDATEE GKLLRLKQQFFLCSASLQDIIFRFKERKSDRVSGKWSEFPSKVAVQMNDTHPTLAIPELMRLLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNIIGAVYRYKKLKEMSAEEKQKVTPRTVMVGGKAFATYTNAKRIVKLVNDVGAVVNND PDVNKYLKVVFIPNYNNVSVAEVLIPGSELSQHISTAGMEASGTSNMKFSLNGCVIIGTLDGANVEIREEVGEDNFFLFGAKADQVAG LRKDRENGLFKPDPRFEEAKQYIRSGTFGTYDYTPLLDSLEGNSGFPGRGDYFLVGYDFPSYIDAQARVDEAYKDKKKRWIKMSILNTA GSGKFSSDRTIDQYAKEIWGITANPVP |
| 89 | MN.220 | 591 | .............................................GLGRLAACFLDSMATLNLPAWGYGLRYRYGLFKQRIAKEGQBEIAEDMLEKFSPWEIVRHDVVYPVRF FGHVEILPDGRRKSAGGEVLNALAYDVPIPGYKTKNAISLRLWDAKASAEDFNLFQFNDGQYESAAQLHSRAWWICAVLYPGDATEE GKLLRLKQQFFLCSASLQDIIFRFKERKSDRVSGKWSEFPSKVAVQMNDTHPTLAIPELMRLLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 89 | MN.199 | 592 | LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKDPRFEEAKQYIRSGTFGTYDTPLLDSLEGNSGPGRGDYFLVGYDFPSYIDAQARVDEAYKDKKRWIKMSILNTA GSGKFSSDRTIDQYAKEIWGITANPVP |
| 89 | MN.224 | 593 | GNISYHAHYSPHFSPLAFGPEPAYFATAESVRDHLLQRWNDTYLHFHKTDPKQTYYLSMEYLQGRALTNAVGNLGITGAYAEAVKKF GYELEALAGQERDMALGNGGLGRLAACFLDSMATLNLPAWGYGLRYRYGLFKQRIAKEGQEEIAEDMLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKDPRFEEAKQYIRSGTFGTYDTPLLDSLEGNSGPGRGDYFLVGYDFPSYIDAQARVDEAYKDKKRWIKMSILNTA GSGKFSSDRTIDQYAKEIWGITANPVP |
| 89 | MN.218 | 594 | ..............................RLAACFLDSMATLNLPAWGYGLRYRYGLFKQRIAKEGQEEIAEDMLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKDPRFEEAKQYIRSGTFGTYDTPLLDSLEGNSGPGRGE |
| 89 | MN.217 | 595 | ............................RVRYGLFKQRIAKEGQEIAEDMLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKDPRFEEAKQYIRSGTFGTYDTPLLDSLEGNSGFGRGE |
| 89 | MN.215 | 596 | ............................RVRYGLFKQRIAKEGQEIAEDMLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 89 | MN.207 | 597 | LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKPDPRFEEAKQYIRSGTFGTYDTPLLDSLEGNSGPGRGE |
| 89 | MN.223 | 598 | ..ISYHAHYSPHFSPLAFGPEPAYFATAESVRDHLLQRWNDTYLHFHKTDPKQTYLSMEYLQGRALTNAVGNLGITFAYAEAVKKF GYELEALAGQERDMALGNGGLGRLAACFLDSMATLNLPAWGYGLRYRYGLFKQRIAKEGQEEIAEDWLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKT ..VKKF |
| 89 | MN.221 | 599 | GYELEALAGQERDMALGNGGLGRLAACFLDSMATLNLPAWGYGLRYRYGLFKQRIAKEGQEEIAEDWLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKPDPRFEEAKQYIRSGTFGTYDTPLLDSLEGNSGPGRGDYFLVGYDFPSYIDAQARVDEAYKDKKRWIKMSILNTA GSGKFSSDRTIDQYAKEIWGITANPVP |
| 89 | MN.222 | 600 | ..RPRRRLAACFLDSMATLNLPAWGYGLRYRYGLFKQRIAKEGQEEIAEDWLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKPDPRFEEAKQYIRSGTFGTYDTPLLDSLEGNSGPGRGDYFLVGYDFPSYIDAQARVDEAYKDKKRWIKMSILNTA GSGKFSSDRTIDQYAKEIWGITANPVP |
| 89 | MN.216 | 601 | ..RPRRRLAACFLDSMATLNLPAWGYGLRYRYGLFKQRIAKEGQEEIAEDWLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVVRYKKLKEMSAEEKQKVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFFLFGAKADQVAG LRKDRENGLFKPDPRFEEAKQYIRSGTFGTYDTPLLDSLEGNSGPGRGDYFLVGYDFPSYIDAQARVDEAYKDKKRWIKMSILNTA GSGKFSSDRTIDQYAKEIWGITANPVP ..FRYGLFQRIAKEGQEEIAEDWLEKFSPWEIVRHDVVYPVRF FGHVEISPDGSRKSAGGEVLNALAYDVPIPGYKTKNAISLRLWDAKASAEDFNLFQFNDGQYESAAWLHSRAWWICAVLYPGDATEE GKLLRLKQQFFLCSASLQDIIFRFKERKSDRVSGKWSEFPSKVAVQMNDTHPTLAIPELMRLLMDEEGLGWDEAWDVTNKTVAYTNH TVLPEALEKWSQSVMRKLLPRQMEIIEEIDKRFREMVISTRKDMEGKLDSMSVLDNSPQKPVVRMANLCVVSAHTVNGVAELHSNIL |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 90 | MN.162 | 602 | KEELFADYVSIWPKKFQNKTNGITPRRWLRFCNPELSEIVTKWLKTDQWTSNLDLLTGLRKFADDEKLHAEWAAAKLASKKRLAKHV LDATGVTIDPTSLFDIQIKRIHEYKRQLMNILGAVRYKLKEMSAEEKQVTPRTVMVGGKAFATYTNAKRIVKLVNDVGAVVNND PDVNKYLKVVFIPNYNVSVAEVLIPGSELSQHISTAGMEASGTSNMKFSLNGCVIIGTLDGANVEIREEVGEDNFLFGAKADQVAG LRKDRENGLFKPDPRRFEEAKQYIRSGTFGTYDYTPLLDSLEGNSGPGRGDYFLVGYDFPSYIDAQARVDEAYKDKKRWIKMSILNTA |
| 90 | MN.142 | 603 | SIHTDTHARHAQSLPRKQKTHEAMALRTLASKKTLAVALGGARPLATRGVATFTLPDLPYDYGALEPAISGEIMRLHHQKHHATYVA NYNKALEQLDAAVSKGDASAVVQLQGAIKFNGGGHVNHSIFWKNLKPTNEGGGEAPHGKLGWAIDEDFGSFDKLVKKMNAEGAALQG SGWVWLALDKEAKKLSVETTANQDPLVTKGANLIPLLGIDVWEHAYYLQYKNVRPDYLTNIWKVVNMKYAGEEYENVAA |
| 90 | MN.158 | 604 | ..........RKQKTHEAMALRTLASKKTLAVALGGARPLATRGVATFTLPDLPYDYGALEPAISGEIMRLHHQKHHATYVA NYNKALEQLDAAVSKGDASAVVQLQGAIKFNGGGHVNHSIFWKNLKPTNEGGGEAPHGKLGWAIDEDFGSFDKLVKKMNAEGAALQG SGWVWLALDKEAKKLSVETTANQDPLVTKGANLIPLLGIDVWEHAYYLQYKN |
| 90 | MN.141 | 605 | ..........ARHAQSLPRKQKTHEAMALRTLASKKTLAVALGGARPLATRGVATFTLPDLPYDYGALEPAISGEIMRLHHQKHHATYVA NYNKALEQLDAAVSKGDASAVVQLQGAIKFNGGGHVNHSIFWKNLKPTNEGGGEAPHGKLGWAIDEDFGSFDKLVKKMNAEGAALQG SGWVWLALDKEAKKLSVETTANQDPLVTKGANLIPLLGIDVWEHAYYLQYKNVRPDYLTNIWKVVNMKYAGEEYENVAA |
| 90 | MN.53 | 606 | ..........LATRGVATFTLPDLPYDYGALEPAISGEIMRLHHQKHHATYVA NYNKALEQLDAAVSKGDASAVVQLQGAIKFNGGGHVNHSIFWKNLKPTNEGGGEAPHGKLGWAIDEDFGSFDKLVKKMNAEGAALQG SGWVWLALDKEAKKLSVETTANQDPLVTKGANLIPLLGIDVWEHAYYLQYKNVRPDYLTNIWKVVNMKYAGEEFFFFF..........G |
| 90 | MN.111 | 607 | ..........RHAQSLPRKQKTHEAMALRTLASKKTLAVALGGARPLATRGVATFTLPDLPYDYGALEPAISGEIMRLHHQKHHATYVA NYNKALEQLDAAVSKGDASAVVQLQGAIKFNGGGHVNHSIFWKNLKPTNEGGGEAPHGKLGWAIDEDFGSFDKLVKKMNAEGAALQG SGWVWL |
| 90 | MN.112 | 608 | ..........HSIFWKNLKPTNEGGGEAPHGKLGWAIDEDFGSFDKLVKKMNAEGAALQG SGWVWLALDKEAKKLSVETTANQDPLVTKGANLIPLLGIDVWEHAYYLQYKNVRPDYLTNIWKVVNMKYAGEEYENVAAEYFV |
| 91 | MN.120 | 609 | ..........PGDRPSEMAANPRVFFDVTIGGAPAGRIVMELYADVVPKTAENFRALCTGEKGVGKMGKPLHYKGSSFHRVIPGF MCQGGDFTAGNGTGGESIYGAKFADENFIKKHTGEGVLSMANAGPGTNGSQFFLCTAKTAWLDGKHVVFGGVVEGMDVVKAVEKVGS QSGRCSKPVVIADCGQL |
| 91 | MN.130 | 610 | RNPNPQTPASTDPGDRASEMAANPRVFFDVTIGGAPAGRIVMELYADVVPKTAENFRALCTGEKGVGKMGKPLHYKGSSFHRVIPGF MCQGGDFTAGNGTGGESIYGAKFADENFIKKHTGEGVLSMANAGPGTNGSQFFLCTAKTAWLDGKHVVFGGVVEGMDVVKAVEKVGS QSGRCSKPVVIADCGQL |
| 91 | MN.132 | 611 | ..........MAPNPKVFFDITIGGAPSGRIVMELYADVVPKTAENFRALCTGEKGVGKMGKPLHYKGSSFHRVIPGF MCQGGDFTAGNGTGGESIYGAKFADENFIKKHTGEGVLSMANAGPGTNGSQFFLCTAKTAWLDGKHVVFGGVVEGMDVVKAVEKVGS QSGRCSKPVVIADCGQL |
| 91 | MN.12 | 612 | ..........MAPNPKVFFDITIGGAPSGRIVMELYADVVPKTAENFRALCTGEKGVGKMGKPLHYKGSSFHRVIPGF MCQGGDFTAGNGTGGESIYGAKFADENFIKKHTGEGVLSMANAGPGTNGSQFFLCTAKTAWLDGKHVVFGGVVEGMDVVKAVEKVGS QSGRCSKPVVIADCGQL |

TABLE 1-continued

Panel of open reading frames corresponding to protein clusters identified by transcriptomic analysis of Timothy Grass (TG) pollen.

| Prot. id | ORF ID | SEQ ID | ORF_sequence (SEQ ID NOS: 1-620) |
|---|---|---|---|
| 91 | MN.121 | 613 | .................MAPNPKVFFDITIGGAPSGRIVMELYADVVPKTAENFRALCTGEKGVGKMGKPLHYKGSSFHRVIPGF MCQGGDFTAGNTGGGESIYGAKFADENFIKKHTGEGVLSMANAGPGTNGSQFFLCTAKTAWLDGKHVVFGQVVEGMDVVKAVEKVGS QSGRCSKPVVIADCGQL |
| 91 | MN.139 | 614 | .................MAPNPKVFFDITIGGAPSGRIVMELYADVVPKTAENFRALCTGEKGVGKMGKPLHYKGSSFHRVIPGF MCQGGDFTAGNTGGGESIYGAKFADENFIKKHTGEGVLSMANAGPGTNGSQFFLCTAKTAWLDGKHVVFGQVVEGMDVVKAVEKVGS QSGRCSKPVVIADCGQL |
| 91 | MN.146 | 615 | .................MAPNPKVFFDITIGGAPSGRIVMELYADVVPKTAENFRALCTGEKGVGKMGKPLHYKGSSFHRVIPGF MCQGGDFTAGNTGGGESIYGAKFADENFIKKHTGEGVLSMANAGPGTNGSQFFLCTAKTAWLDGKHVVFGQVVEGMDVVKAVEKVGS QSGRCSKPVVIADCGQL |
| 91 | MN.64 | 616 | ..............................AKFADENFVKKHTGPGVLSMANAGPGTNGSQFFLCTAKTAWLDGKHVVFGQVVKAIEKVGS QSGRCSKPVVIADCGQL |
| 91 | MN.87 | 617 | ..............................................................................PLKWSGF MCQGGDFTAGNTGGGESIYGAKFADENFIKKHTGEGVLSMANAGPGTNGSQFFLCTAKTAWLDGKHVVFGQVVEGMDVVKAVEKVGS QSGRCSKPVVIADCGQL |
| 91 | MN.89 | 618 | ....................................................................GSSFHRVIPDF MCQGGDFTAGNTGGGESIYGAKFADENFIKKHTGEGVLSMANAGPGTNGSQFFLCTAKTAWLDGKHVVFGQVVEGMDVVKAVEKVGS QSGRCSKPVVIADCGQL |
| 92 | MN.37 | 618 | SQVHIRRPGGAGRDGGQLRIPSLLHGGHGCAQPAMERRKHIEWNCDVCRHGDDKKKVD |
| 93 | MN.164 | 620 | WTTVMRASCGHHRFRDCVISSLADFKLFPVLQHIISIAVLAIFIGLLMIEDTGA |

TABLE 2

Panel of peptides predicted from protein sequences identified by
transcriptomic anaylsis of Timothy Grass (TG) pollen.

| peptide_sequence (SEQ ID NOS:621-1442) | Prot. ID | SEQ ID | ORF (start-stop) |
|---|---|---|---|
| SDGTFARAAVPSGAS | 1 | 621 | M.125 (11-25), M.151 (38-52), M.226 (44-58), M.291 (11-25), M.331 (11-25), M.399 (44-58), M.414 (39-53), M.418 (43-57), M.498 (38-52), M.617 (8-22), M.624 (31-25), M.689 (37-51), M.704 (8-22), M.714 (33-47), M.721 (11-25) |
| RAAVPSGASTGVYEA | 1 | 622 | M.125 (17-31), M.151 (44-58), M.266 (50-64), M.291(17-31), M.331(17-31), M.399 (50-64), M.414 (45-59), M.418 (49-63), M.498 (44-58), M.617 (14-28), M.624 (17-31), M.689 (43-57), M.704 (14-28), M.714 (39-53), M.721 (17-31) |
| GASTGVYEALELRDG | 1 | 623 | M.125 (23-37), M.151 (50-64), M.226 (56-70), M.291 (23-37), M.331 (23-37), M.399 (56-70), M.414 (51-65), M.418 (55-69), M.498 (50-64), M.617 (20-34), M.624 (23-37), M.689 (49-63), M.704 (20-34), M.714 (45-59), M.723 (23-37) |
| LGKGVLKGNRANVEL | 1 | 624 | M.125 (42-56) |
| NRANVELFHIAVLLA | 1 | 625 | M.125 (50-64) |
| QTELDNFMVHQLDGT | 1 | 626 | M.291 (69-83), M.331 (69-83), M.399 (102-116), M.414 (97-111), M.418(101-115), M.498 (96-110), M.617 (66-80), M.624 (69-83), M.644 (30-44), M.689 (95-109), M.692 (29-43), M.693 (30-44), M.704 (66-80), M.705 (29-43), M.714 (91-105), M.721(69-83) |
| CKQKVFFNISADADA | 1 | 627 | M.331 (90-104) |
| PAMAATIQSVKARQI | 1 | 628 | M.151 (8-22), M.226 (14-28), M.399 (14-28), M.414 (9-23), M.418 (13-27), M.498 (8-22), M.689 (7-21), M.714 (3-17) |
| VDNVNSIIGPALIGK | 1 | 629 | M.291 (50-64), M.331 (50-64), M.399 (83-97), M.414 (78-92), M.498 (77-91), M.617 (47-63), M.624 (50-64), M.644 (11-25), M.692 (10-24), M.693 (11-25), M.704 (47-61), M.714 (72-86) |
| KLGANAILAVSLAVC | 1 | 630 | M.414 (121-135), M.418 (125-139), M.498 (120-134), M.617 (90-104), M.624 (93-107), M.644 (54-68), M.689 (119-133), M.692 (53-67), M.693 (54-68), M.704 (90-104), M.705 (53-67), M.714 (115-129), M.721 (93-107) |
| KKIPLYQHIANLAGN | 1 | 631 | M.414 (142-156), M.418 (146-160), M.498 (141-155), M.561 (12-26), M.603(12-26), M.604 (16-30), M.617 (111-125), M.624 (114-128), M.644 (75-89), M.689 (140-154), M.692 (74-88), M.693 (75-89), M.704 (111-125), M.705 (74-88), M.714 (136-150), M.721 (114-128) |
| GNKQLVLPVPAFNVI | 1 | 632 | M.498 (154-168), M.561 (25-39), M.591 (4-18), M.603 (25-39), M.604 (29-43), M.617 (124-138), M.624 (127-141), M.644 (88-102), M.689 (153-167), M.692 (87-101), M.693 (88-102), M.704 (124-138), M.705 (87-101), M.714 (149-163), M.721 (127-141) |
| KLAMQEFMILPTGAS | 1 | 633 | M.498 (177-191), M.561 (48-62), M.591 (27-41), M.603 (48-62), M.604 (52-66), M.617 (147-161), M.624 (150-164), M.644 (111-125), M.689 (176-190), M.692 (110-124), M.693 (111-125), M.704 (147-161), M.705 (110-124), M.714 (172-186), M.721 (150-164) |
| KMGVEVYHNLKSVIK | 1 | 634 | M.498 (198-212), M.561 (69-83), M.591 (48-62), M.603 (69-83), M.604 (73-87), M.617 (168-182), M.624 (171-185), M.644 (132-146), M.689 (197-211), M.692 (131-145), M.693 (132-146), M.704 (168-182), M.705 (131-145), M.714 (193-207), M.721 (171-185) |
| GKVVIGMDVAASEFY | 1 | 635 | M.561 (124-136), M.591 (101-117), M.603 (124-136), M.604 (126-142), M.617 (223-237), M.624(226-240), M.644 (187-201), M.689 (252-266), M.692 (186-200), M.693 (187-201), M.704 (223-237), M.705 (186-200), M.714 (248-262), M.721 (226-240) |
| VYKSFVSEYPIVSIE | 1 | 636 | M.561 (168-182), M.591 (147-161), M.603 (168-182), M.604 (172-186), M.617 (267-281), M.624 (270-284), M.644 (231-245), M.689 (296-310), M.692 (230-244), M.693 (231-245), M.704 (267-281), M.705 (230-244), M.714 (292-603), M.721 (270-284) |
| IVGDDLLVTNPTRVA | 1 | 637 | M.561 (206-220), M.591 (185-199), M.603 (206-220), M.604 (210-224), M.617 (305-319), M.624 (308-122), M.644 (269-283), M.689 (334-348), |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| | | | M.692 (268-282), M.693 (269-283), M.704 (305-319), M.705 (268-282), M.714 (330-344), M.721 (308-322) |
| NALLLKVNQIGSVTE | 1 | 638 | M.561 (229-243), M.591 (208-222), M.603 (229-243), M.604 (233-247), M.644 (292-306), M.689 (357-371), M.692 (291-305), M.693 (292-306), M.704 328-342), M.705 (291-305), M.714 (353-367), M.721 (331-345) |
| ETEDTFIADLAVGLS | 1 | 639 | M.591 (245-259), M.603 (266-280), M.604 (270-284), M.644 (329-343), M.692 (328-342), M.693 (329-343), M.704 (635-379), M.708 (328-342), M.714 (390-404), M.721 (368-382) |
| ERLAKYNQLLRIEEE | 1 | 640 | M.591 (272-286), M.603 (293-307), M.604 (297-311), M.692 (355-369), M.693 (356-370), M.704 (392-406), M.705 (355-369), M.714 (417-431), M.721 (395-409) |
| LGAAAVYAGLKFRAP | 1 | 641 | M.692 (370-384), M.693 (371-385), M.705 (370-384), M.721 (410-424) |
| ADPCSEYFVEAYLNN | 58 | 642 | M.203 (12-26), M.329 (11-25), M.330 (2-16) |
| YFVEAYLNNPLVQKA | 58 | 643 | M.203 (18-32), M.329 (17-31), M.330 (8-27) |
| VQKAIHANTALNYPW | 58 | 644 | M.130 (4-18), M.131 (4-18), M.203 (29-43), M.316 (4-18), M.323 (3-17), M.329 (28-42), M.330 (19-33), M.345 (3-17) |
| PSMLAHIKALVTTGI | 58 | 645 | M.130 (36-50), M.131 (38-50), M.203 (61-75), M.292 (31-45), M.316 (36-50), 329 (60-74), M.70 (31-45) |
| LYSGDLDAMVPVTAS | 58 | 646 | M.128 (48-62), M.227 (47-61), M.316 (54-68) |
| LNYPWTGCRTRTYNL | 58 | 647 | M.128 (8-22), M.330 (14-28), M.131 (14-28), M.203 (39-53), M.227 (7-21), M.292 (9-23), M.316 (14-28), M.123 (13-27), M.329 (38-52), M.330 (29-43), M.345 (13-27), M.70 (9-23) |
| YLNRRFGASPPSMLA | 58 | 648 | M.345 (25-39) |
| HIKALVTTASASGCT | 58 | 649 | M.323 (40-54), M.345 (40-54) |
| QEMAYWSLKAAIEIG | 33 | 650 | M.365 (0-14) |
| DAASSLYLFGENLPR | 33 | 651 | M.365 (19-33) |
| GYNISLASMIPDYDT | 33 | 652 | M.241 (0-14), M.289 (1-15) |
| YDTVITNVRRSLAVA | 33 | 653 | M.172 (0-14), M.214 (12-26), M.239 (9-23), M.240 (7-21), M.289 (13-27), M.296 (26-40), M.365 (71-85), M.72 (0-14) |
| LEKIVAILSAFVDAA | 33 | 654 | M.172 (44-58), M.214 (56-70), M.240 (51-65), M.289 (57-71), M.38 (35-49) |
| NVRRSLAVAKKNHLA | 33 | 655 | M.172 (6-20), M.214 (16-32), M.239 (18-29), M.240 (13-27), M.289 (19-33), M.296 (32-46), M.365 (77-91), M.72 (6-20) |
| VAKKNHLAWNCERCR | 33 | 656 | M.172 (13-27), M.187 (13-27), M.214 (25-39), M.239 (22-36), M.240 (20-34), M.289 (26-40), M.296 (39-53), M.365 (84-98), M.38 (4-18), M.72 (13-27) |
| LAWNCERCRKGESKK | 33 | 657 | M.172 (19-33), M.187 (19-33), M.214 (31-45), M.239 (28-42), M.240 (26-40), M.289 (32-45), M.295 (45-59), M.385 (90-304), M.38 (10-24), M.72 (19-33) |
| KKTVDAILSAFVDAA | 33 | 658 | M.72 (32-46) |
| GSGDFKTIKEALAKV | 21 | 659 | M.178 (0-14), M.191 (0-14), M.29 (1-15) |
| MYVMYIKEGTYKEYV | 21 | 660 | M.107 (9-23), M.133 (7-21), M.166 (10-24), M.123 (9-23), M.129 (10-24), M.149 (10-24), M.164 (10-24), M.174 (3-17), M.178 (21-35), M.191 (21-35), M.29 (22-36), M.3 (4-18) |
| YKEYVTVPRTVTNLV | 21 | 661 | M.107 (19-33), M.113 (17-31), M.116 (20-34), M.123 (19-33), M.129 (20-34), M.149 (20-34), M.164 (20-34), M.174 (3-17), M.178 (31-45), M.191 (31-45), M.29 (32-45), M.3 (14-28) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| VTNLVMIGDGAAKTI | 21 | 662 | M.107 (29-43), M.113 (27-41), M.116 (30-44), M.123 (29-43), M.129 (30-44), M.149 (30-44), M.164 (30-44), M.174 (23-37), M.178 (41-55), M.191 (41-55) |
| NFKMNLTSMVAVSLV | 21 | 663 | M.123 (49-63) |
| YQDTLYTHAQRQFFR | 21 | 664 | M.101 (36-50), M.146 (49-63), M.165 (51-65), M.183 (36-50), M.204 (49-63), M.34 (19-33), M.6 (17-31) |
| GTIDFTFGNEQVVIQ | 21 | 665 | M.183 (56-70) |
| AKTIILKFLLPVMIV | 21 | 666 | M.178 (52-66) |
| ALTHTTIVASGIENM | 8 | 667 | M.763 (0-14) |
| MKIFTRTWVLLLLVV | 8 | 668 | M.763 (14-28), M.765 (11-25) |
| LLLLVVLLFEGCLAK | 8 | 669 | M.763 (23-37), M.765 (20-34) |
| KDTHYTLSAWLQLSK | 8 | 670 | M.733 (16-30), M.759 (57-71), M.763 (109-123), M.765 (106-120) |
| GKGELFFETNVTAEL | 8 | 671 | M.653 (28-42), M.728 (34-48), M.733 (72-86), M.759 (113-127), M.763 (165-179), M.765 (162-176) |
| VTAELMVDSMSLQPF | 8 | 672 | M.653 (38-52), M.728 (44-58), M.733 (82-96), M.763 (175-189) |
| YEKWFTSRFTVATME | 8 | 673 | M.653 (115-129), M.728 (121-135), M.733 (159-173), M.747 (73-87), M.759 (199-213), M.763 (252-266), M.765 (248-262) |
| KQMDWVSKLSAPQLK | 8 | 674 | M.653 (175-189), M.728 (181-195), M.733 (219-233), M.747 (133-147), M.759 (259-273), M.763 (312-326), M.765 (308-322) |
| KPILFMNEYNTIEEP | 8 | 675 | M.653 (244-258), M.728 (250-264), M.733 (288-302), M.747 (202-216), M.759 (328-342), M.763 (318-395), M.765 (377-391) |
| TKYLAKLKQIQSYPG | 8 | 676 | M.653 (266-280), M.728 (272-286), M.733 (310-324), M.747 (224-238), M.759 (350-364), M.763 (403-417), M.763 (403-417), M.765 (399-413) |
| PYVRGSLDTLAQAKV | 8 | 677 | M.653 (300-314), M.728 (306-320), M.733 (344-358), M.747 (258-272), M.759 (384-398), M.763 (437-451), M.765 (433-447) |
| PKQVEYLEEVMREGF | 8 | 678 | M.653 (327-341), M.728 (333-347), M.733 (371-385), M.747 (285-299), M.759 (411-425), M.763 (464-478), M.765 (460-474) |
| NVTAELVDSMSLQPF | 8 | 679 | M.759 (122-136), M.765 (171-185) |
| NIPATWGAMEKLYDA | 18 | 680 | M.8 (0-14) |
| GAMEKLYDAGKARAI | 18 | 681 | M.8 (6-20) |
| KARAIGVSNLASKKL | 18 | 682 | M.8 (16-30) |
| VSNLASKKLGDLLAV | 18 | 683 | M.8 (22-36) |
| KKLGDLLAVARIPPA | 18 | 684 | M.8 (28-42) |
| SVFKKFPKFRRVLVI | 55 | 685 | M.110 (3-17), M.173 (11-25), M.249 (13-27) |
| PKFRRVLVIDPVISG | 55 | 686 | M.110 (9-23), M.173 (17-31), M.18 (4-18), M.249 (19-33), M.33 (0-14), M.50 (9-23) |
| IGEIKGFADAVMVSR | 55 | 687 | M.110 (29-43), M.173 (37-51), M.18 (24-38), M.249 (39-53), M.33 (20-34), M.50 (29-43) |
| FADAVMVSRGSLVRV | 55 | 688 | M.110 (35-49), M.173 (43-57), M.18 (30-44), M.249 (45-59), M.33 (26-40), M.50 (35-49) |
| VSRGSLVRVNGFFLT | 55 | 689 | M.110 (41-55), M.249 (51-65), M.33 (32-45), M.50 (41-55) |
| VNGFFLTGFNDLVTE | 55 | 690 | M.249 (59-73) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| QIIRKGFYLTKNVEH | 31 | 691 | M.39 (5-19) |
| FYLTKNVEHKGQVDL | 31 | 692 | M.39 (11-25) |
| VENKGQVDLVTETDK | 31 | 693 | M.39 (17-31) |
| TDKACEDLIFNHLRK | 31 | 694 | M.39 (29-43) |
| DLIFNHLRKLYPDHK | 31 | 695 | M.39 (35-49) |
| AEFEGVFLDFARQQA | 2 | 696 | M.574 (0-14) |
| VDKLFKLAEAAKLKE | 2 | 697 | M.574 (19-33) |
| ENRSVLHVALRAPRD | 2 | 698 | M.422 (8-22), M.431 (8-22), M.473 (0-14), M.574 (48-62), M.634 (24-38), M.676 (24-38) |
| FLGPLFVHTALQTDP | 2 | 699 | M.367 (54-68), M.422 (75-89), M.431 (75-89), M.437 (36-50), M.473 (67-81), M.574 (115-129), M.610 (32-46), M.634 (91-105), M.676 (91-105), M.722 (32-46) |
| RQLRFLANVDPVDVA | 2 | 700 | M.387 (77-91), M.422 (98-112), M.431 (98-112), 437 (59-73), M.473 (90-140), M.531 (8-22), M.574 (138-152), M.610 (55-69), M.634 (114-128), M.676 (114-128), M.722 (55-69) |
| VVSKTFTTAETMLNA | 2 | 701 | M.387 (106-120), M.422 (127-141), M.431 (127-141), M.437 (88-102), M.473 (119-133), M.531 (37-51), M.574 (167-181), M.610 (84-98), M.634 (143-157), M.676 (143-157), M.722 (84-98) |
| IKEWIVSSLGPQAVS | 2 | 702 | M.387 (123-137), M.431 (144-158), M.437 (105-119), M.473 (136-150), M.531 (54-68), M.574 (184-198), M.610 (101-115), M.634 (160-174), M.676 (160-174), M.722 (101-115) |
| VSKHMIAVSTNLKLV | 2 | 703 | M.473 (118-132), M.473 (149-163), M.531 (67-81), M.574 (197-211), M.610 (114-128), M.634 (173-187), M.676 (173-187), M.722 (114-128) |
| RYSVCSAVGVLPLSL | 2 | 704 | M.473 (152-166), M.473 (183-197), M.531 (101-115), M.574 (231-245), M.610 (148-162), M.634 (207-221), M.676 (207-221), M.722 (148-162) |
| AVGVLPLSLQYGFPI | 2 | 705 | M.533 (107-121), M.574 (237-251), M.610 (154-168), M.534 (213-227), M.676 (213-227), M.722 (154-168) |
| LSLQYGFPIVQRFLE | 2 | 706 | M.531 (113-127), M.574 (243-257), M.610 (160-174), M.634 (219-233), M.676 (219-233), M.722 (160-174) |
| FPIVQRFLEGASSID | 2 | 707 | M.531 (119-133), M.574 (249-263), M.610 (166-180), M.634 (226-239), M.636 (2-16), M.676 (225-239), M.722 (166-180) |
| HFRTASFEKNIPVLL | 2 | 708 | M.531 (135-149), M.574 (265-279), M.610 (182-196), M.634 (241-255), M.636 (18-32), M.676 (241-255), M.722 (182-196) |
| VLLGLLSVWNVSFLQ | 2 | 709 | M.531 (147-161), M.610 (194-208), M.634 (253-267), M.636 (30-44), M.676 (253-267), M.722 (194-208) |
| SVWNVSFLGYPARAI | 2 | 710 | M.531 (153-167), M.610 (200-214), M.634 (259-273), M.636 (36-50), M.676 (259-273), M.722 (200-214) |
| ARAILPYSQALEKLA | 2 | 711 | M.531 (164-178), M.610 (211-255), M.634 (270-284), M.636 (47-61), M.676 (270-284), M.277 (211-225) |
| NGQHSFYQLIHQGRV | 2 | 712 | M.531 (215-299), M.610 (262-276), M.634 (321-355), M.636 (98-112), M.676 (321-335), M.722 (262-276) |
| CDFIGVIKSQQPVYL | 2 | 713 | M.531 (232-246), M.610 (279-293), M.636 (115-129), M.676 (338-352), M.722 (279-293) |
| ELMSNFFAQPDALAY | 2 | 714 | M.610 (303-317), M.636 (139-153), M.676 (362-376) |
| KTFKGNRPSLSFLLS | 2 | 715 | M.363 (173-187), M.722 (337-351) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| PSLSFLLSSLSAYEI | 2 | 716 | M.636 (180-194), M.722 (355-358) |
| AYEIGQLLAIYEHRI | 2 | 717 | M.636 (191-205), M.722 (358-369) |
| LLAIYEHRIAVQGFI | 2 | 718 | M.636 (197-211), M.722 (631-375) |
| QGFIWGINSFDQWQV | 2 | 719 | M.636 (208-222), M.722 (372-386) |
| PVEGFNPSSASLLAR | 2 | 720 | M.636 (245-259), M.722 (409-423) |
| PSSASLLARYLAVEP | 2 | 721 | M.636 (251-265), M.722 (415-429) |
| KELGGKILRQPGPLP | 56 | 722 | M.25 (1-15) |
| ILRQPGPLPGLNTKI | 56 | 723 | M.25 (7-21) |
| LRGLNTKIASFLDPD | 56 | 724 | M.25 (5-19) |
| KIASFLDPDGWKVVL | 56 | 725 | M.25 (20-34), M.5 (11-25) |
| GWKVVLVDHADFLKE | 56 | 726 | M.25 (29-43), M.5 (20-34) |
| QDNAKIVQIDSSIQA | 57 | 727 | M.394 (2-16) |
| RLVCLRVHPTFTLLH | 57 | 728 | M.394 (28-42) |
| HPTFTLLHPTEVVVA | 57 | 729 | M.394 (35-49) |
| TEVVVAFTAINGSRQ | 57 | 730 | M.394 (44-58) |
| LVNRFEISQVSKCLV | 57 | 731 | M.394 (90-104) |
| ILLVFAETAEPEVKV | 3 | 732 | M.305 (0-14) |
| EPEVKVVDLTILSPD | 3 | 733 | M.212 (7.21), M.271 (3-17), M.282 (14-28), M.288 (3-17), M.305 (9-23) |
| LKDGSTYSFRFSFIV | 3 | 734 | M.212 (42-56), M.271 (38-52), M.282 (49-63), M.288 (38-52), M.305 (44-58) |
| SFRFSFIVSNNIVSG | 3 | 735 | M.212 (49-63), M.271 (45-59), M.282 (56-70), M.285 (1-15), M.288 (45-59), M.305 (51-65), M.348 (1-15) |
| DDGKVYLEMSYYFEI | 3 | 736 | M.519 (45-59), M.285 (74-88), M.287 (51-65), M.348 (74-88), M.83 (27-41) |
| VKKIVTVLNEAEVPS | 59 | 737 | M.596 (20-34), M.660 (8-22), M.674 (35-49), M.685 (35-49), M.703 (34-48) |
| EDAVEVVVSPPFVFL | 59 | 738 | M.585 (49-63), M.596 (35-49), M.660 (23-37), M.674 (50-64), M.681 (49-63), M.685 (50-64), M.703 (49-63) |
| VSPPFVFLQQAKALL | 59 | 739 | M.504 (1-15), M.585 (56-70), M.596 (42-56), M.660 (30-44), M.674 (57-71), M.681 (56-70), M.685 (57-71), M.703 (56-70) |
| FLQQAKALLRPDFAV | 59 | 740 | M.504 (7-21), M.585 (62-76), M.596 (48-62), M.660 (36-50), M.674 (63-77), M.681 (62-76), M.685 (63-77), M.703 (62-76) |
| ALLRPDFAVAAQNCW | 59 | 741 | M.585 (68-82), M.596 (54-68), M.660 (42-56), M.674 (69-83), M.681 (68-82), M.685 (69-83), M.703 (68-82) |
| GAFTGEISAEMLVNL | 59 | 742 | M.504 (32-46), M.585 (87-101), M.596 (73-87), M.660 (61-75), M.674 (88-102), M.681 (87-101), M.685 (88-102), M.703 (87-101) |
| ISAEMLVNLQVPWVI | 59 | 743 | M.504 (38-52), M.585 (93-107), M.596 (79-93), M.660 (67-81), M.674 (94-108), M.681 (93-107), M.685 (94-108), M.703 (93-107) |
| ESNDFVADKVAYALA | 59 | 744 | M.504 (64-78), M.585 (119-133), M.596 (105-119), M.660 (93-107), M.674 (120-134), M.681 (119-133), M.685 (120-134), M.703 (119-133) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| ADKVAYALAQGLKVI | 59 | 745 | M.504 (70-84), M.585 (125-139), M.596 (111-125), M.660 (99-113), M.674 (126-140), M.681 (125-139), M.685 (126-140), M.703 (125-139) |
| TTMEVVAAQTKAIAE | 59 | 746 | M.504 (98-112), M.526 (13-27), M.585 (153-167), M.596 (139-153), M.660 (127-141), M.674 (154-168), M.681 (153-167), M.685 (154-168), M.703 (153-167) |
| WTNVVLAYEPVWAIG | 59 | 747 | M.504 (117-131), M.526 (32-46), M.585 (172-186), M.596 (158-172), M.660 (146-160), M.674 (173-187), M.681 (172-185), M.685 (173-187), M.703 (172-186) |
| LRKWLHANVGPAVAE | 59 | 748 | M.504 (148-162), M.526 (63-77), M.585 (203-217), M.596 (189-203), M.660 (177-191), M.674 (204-218), M.681 (203-217), M.685 (204-218), M.703 (203-217) |
| PEFVDIIKSATVKSS | 59 | 749 | M.504 (198-232), M.526 (113-127), M.585 (253-267), M.596 (239-253), M.660 (227-241), M.674 (254-268), M.681 (253-267), M.685 (254-268), M.703 (253-267) |
| LNGPFIATVQQRGAA | 19 | 750 | M.235 (25-39) |
| QQRGAAIIKARKLSS | 19 | 751 | M.235 (34-48) |
| IIKARKLSSALSAAS | 19 | 752 | M.235 (40-54) |
| LSSALSAASSACDHI | 19 | 753 | M.235 (46-60) |
| GTPEGTFVSMGVYSD | 19 | 754 | M.235 (66-80) |
| IEIDSLFEGIDFYST | 32 | 755 | M.389 (40-54), M.390 (40-54) |
| IDFYSTITRARFEEL | 32 | 756 | M.389 (49-63), M.390 (49-63) |
| IPKVQQLLQDFFNGK | 32 | 757 | M.144 (40-54), M.201 (44-58), M.28 (26-40), M.284 (52-56), M.303 (52-66), M.389 (101-115), M.390 (101-115), M.74 (19-33), M.92 (34-48) |
| EAVAYGAAVQAAILS | 32 | 758 | M.284 (76-90), M.303 (76-90), M.317 (7-21), M.389 (125-139), M.390 (125-139), M.74 (43-57) |
| VQDLLLLDVTPLSLG | 32 | 759 | M.180 (11-25), M.317 (28-42) |
| LMSFSWICACVRAAA | 34 | 760 | M.607 (0-14) |
| ICACVRAAAVAWEAG | 34 | 761 | M.607 (6-20), M.690 (4-18) |
| VRVKILFTALCHTDV | 34 | 762 | M.598 (34-48), M.607 (68-52), M.614 (13-27), M.632 (27-41), M.672 (23-37), M.690 (36-50) |
| MCDLLRINTDRGVMI | 34 | 763 | M.545 (18-32), M.598 (109-123), M.607 (113-127), M.614 (88-102), M.616 (47-61), M.632 (102-116), M.633 (42-56), M.671 (43-57), M.672 (98-112), M.690 (111-125) |
| KPIFHFVGTSTFSEY | 34 | 764 | M.545 (44-58), M.598 (135-149), M.607 (139-153), M.614 (114-128), M.616 (73-87), M.632 (128-142), M.633 (68-82), M.671 (69-83), M.672 (124-138), M.690 (137-151) |
| VGTSTFSEYTVMHVG | 34 | 765 | M.545 (50-64), M.598 (141-155), M.607 (145-159), M.614 (120-134), M.616 (79-93), M.632 (134-148), M.633 (74-88), M.671 (75-89), M.672 (130-144), M.690 (143-157) |
| VAIFGLGAVGLAAAE | 34 | 766 | M.545 (104-118), M.598 (195-209), M.607 (199-213), M.614 (174-188), M.616 (133-147), M.632 (188-202), M.633 (128-142), M.671 (129-143), M.672 (184-198), M.690 (197-211) |
| GAVGLAAAEGARIAG | 34 | 767 | M.545 (110-124), M.598 (201-215), M.607 (205-219), M.614 (180-194), M.616 (139-153), M.632 (184-208), M.633 (134-148), M.671 (135-149), M.672 (190-204), M.690 (203-217) |

TABLE 2-continued

Panel of peptides predicted from protein sequences identified by
transcriptomic anaylsis of Timothy Grass (TG) pollen.

| peptide_sequence (SEQ ID NOS:621-1442) | Prot. ID | SEQ ID | ORF (start-stop) |
|---|---|---|---|
| GNINAMIQAFECVHD | 34 | 768 | M.545 (179-193), M.598 (270-284), M.607 (274-288), M.614 (249-263), M.616 (208-222), M.622 (263-277), M.633 (203-217), M.671 (204-218), M.672 (259-273), M.690 (272-286) |
| LKGTFFGNFKPRTDL | 34 | 769 | M.545 (223-237), M.614 (293-307), M.616 (252-266), M.632 (307-321), M.633 (247-261), M.671 (248-262), M.672 (303-317), M.690 (316-330) |
| KFITHSVTFSEINKA | 34 | 770 | M.616 (282-296), M.633 (277-291), M.671 (278-292), M.672 (333-347), M.690 (346-360) |
| VTFSEINKAFDLMAK | 34 | 771 | M.616 (288-302), M.633 (283-297), M.671 (284-298), M.672 (339-353), M.690 (352-366) |
| ALRWNLQMGHSVLPK | 35 | 772 | M.272 (0-14) |
| NLDVYDWSIPDDLLA | 35 | 773 | M.272 (24-38) |
| DDLLAKFSEIKQTRL | 35 | 774 | M.272 (34-48) |
| FSEIKQTRLIMGNFI | 35 | 775 | M.272 (40-54) |
| TRLLMGNFIVNKDSV | 35 | 776 | M.272 (46-60) |
| MKRIFDFESIKKLLA | 4 | 777 | M.595 (2-16), M.648 (2-16), M.715 (0-14), M.718 (2-16), M.720 (2-16), M.725 (0-14) |
| FESIKKLLASPKFSF | 4 | 778 | M.595 (8-22), M.648 (8-22), M.662 (7-21), M.694 (11-25), M.701 (11-25), M.715 (6-20), M.718 (8-22), M.720 (8-22), M.723 (5-19), M.725 (6-20) |
| RMFVDELGASESSLL | 4 | 779 | M.595 (37-51), M.648 (67-51), M.662 (36-50), M.694 (40-54), M.701 (40-54), M.715 (35-49), M.718 (37-51), M.720 (37-51), M.273 (34-48), M.725 (35-49) |
| PNLTYAKELVERMGL | 4 | 780 | M.595 (66-80), M.648 (66-80), M.662 (65-79), M.694 (69-83), M.701 (69-83), M.715 (64-78), M.718 (66-80), M.720 (66-820), M.723 (63-77), M.725 (64-78) |
| RNMVLGKRFFVTPSD | 4 | 781 | M.595 (102-116), M.648 (102-116), M.662 (101-115), M.594 (105-119), M.701 (105-119), M.715 (100-114), M.718 (102-116), M.720 (102-116), M.723 (99-113), M.725 (100-114) |
| KRFFVTPSDSVAIIA | 4 | 782 | M.595 (108-122), M.648 (108-122), M.662 (107-121), M.694 (111-125), M.701 (111-125), M.715 (106-120), M.718 (108-122), M.720 (108-122), M.723 (105-119), M.725 (106-120) |
| SDSVAIIAANAVQSI | 4 | 783 | M.595 (115-129), M.648 (115-129), M.662 (114-128), M.694 (118-132), M.701 (118-132), M.715 (113-127), M.718 (115-129), M.720 (115-129), M.723 (112-126), M.725 (113-127) |
| AVQSIPYFASGLKGV | 4 | 784 | M.595 (125-139), M.648 (125-139), M.662 (124-138), M.694 (128-142), M.701 (128-142), M.715 (123-137), M.718 (125-139), M.720 (125-139), M.723 (122-136), M.725 (123-137) |
| KNLNLKFEEVPTGWK | 4 | 785 | M.595 (154-168), M.648 (154-168), M.662 (153-167), M.694 (157-171), M.701 (157-171), M.715 (152-166), M.718 (154-168), M.720 (154-168), M.723 (151-165), M.725 (152-166) |
| GIWAVLAWLSIIAYK | 4 | 786 | M.576 (33-47), M.595 (199-213), M.648 (199-213), M.662 (198-212), M.694 (202-216), M.701 (202-216), M.715 (197-211), M.718 (199-213), M.720 (199-213), M.723 (196-210), M.725 (197-211) |
| NLGGDKLVSVEDIVL | 4 | 787 | M.576 (51-65), M.595 (217-231), M.648 (217-231), M.662 (216-230), M.694 (220-234), M.701 (220-234), M.715 (215-229), M.718 (217-231), M.720 (217-231), M.723 (214-228), M.725 (215-229) |
| LVSVEDIVLQHWATY | 4 | 788 | M.576 (57-71), M.595 (223-237), M.648 (223-237), M.662 (222-236), M.694 (226-240), M.701 (226-240), M.715 (221-235), M.718 (223-237), M.720 (223-237), M.723 (220-234), M.725 (221-235) |

TABLE 2-continued

Panel of peptides predicted from protein sequences identified by
transcriptomic anaylsis of Timothy Grass (TG),pollen.

| peptide_ sequence (SEQ ID NOS:621- 1442) | Prot. ID | SEQ ID | ORF (start-stop) |
|---|---|---|---|
| KELMANLVKMQSALS | 4 | 789 | M.576 (90-104), M.595 (256-270), M.648 (256-270), M.662 (255-269), M.694 (259-273), M.701 (259-273), M.715 (254-268), M.718 (256-270), M.720 (256-270), M.723 (253-267), M.725 (254-268) |
| LVKMQSALSDVNKLI | 4 | 790 | M.576 (96-110), M.595 (262-276), M.648 (262-276), M.662 (261-275), M.694 (265-279), M.701 (265-279), M.715 (260-274), M.718 (262-276), M.720 (262-276), M.723 (259-273), M.725 (260-274) |
| HQGIRYLFGDGSRLV | 4 | 791 | M.576 (139-153), M.648 (305-319), M.662 (304-318), M.694 (308-322), M.701 (308-322), M.715 (303-317), M.718 (305-319), M.720 (305-319), M.723 (302-316), M.725 (303-317) |
| SRLVFRLSGTGSVGA | 4 | 792 | M.576 (150-164), M.648 (316-330), M.662 (315-329), M.694 (319-333), M.701 (319-333), M.715 (314-328), M.718 (316-330), M.720 (316-330), M.723 (313-327), M.725 (314-328) |
| GATIRIYIEQYEKDS | 4 | 793 | M.576 (163-177), M.648 (329-343), M.662 (328-342), M.694 (332-346), M.701 (332-346), M.715 (327-341), M.718 (329-343), M.720 (329-343), M.723 (326-340), M.725 (327-341) |
| DALSPLVDVALKLSK | 4 | 794 | M.576 (186-200), M.662 (351-365), M.694 (355-369), M.701 (355-369), M.715 (350-364), M.718 (352-366), M.720 (352-366), M.723 (349-363), M.725 (350-364) |
| QDFKKVNEIYAKYFP | 36 | 795 | M.202 (0-14), M.301 (0-14) |
| NEIYAKYFPSPAPAR | 36 | 796 | M.202 (6-20), M.301 (6-20) |
| YFPSPAPARSTYQVA | 36 | 797 | M.202 (12-26), M.301 (12-26) |
| ARSTYQVAALPLDAR | 36 | 798 | M.202 (19-33), M.301 (19-33) |
| LPLDARIEIECIAAL | 36 | 799 | M.202 (28-42), M.301 (28-42) |
| PPPGQHIAMAASSRR | 20 | 800 | M.675 (19-33), M.678 (24-38) |
| ASQLLGSAASRFLHS | 20 | 801 | M.675 (34-48), M.678 (39-53) |
| SRFLHSRGYAAAAAA | 20 | 802 | M.675 (43-57), M.678 (48-62) |
| RGYAAAAAAPSPAVF | 20 | 803 | M.675 (49-63), M.678 (54-68) |
| LGLPVFNSVAEAKAE | 20 | 804 | M.583 (15-29), M.641 (53-67), M.649 (22-36), M.675 (108-122), M.678 (113-127) |
| TKANASVIYVPPPFA | 20 | 805 | M.583 (30-44), M.641 (68-82), M.649 (37-51), M.675 (123-137), M.678 (128-142) |
| VIYVPPPFAAAAIME | 20 | 806 | M.583 (36-50), M.641 (74-88), M.649 (43-57), M.675 (129-143), M.678 (134-148) |
| PFAAAAIMEALEAEL | 20 | 807 | M.583 (42-56), M.641 (80-94), M.649 (49-63), M.675 (135-149), M.678 (140-154) |
| QHDMVKVKAALNRQS | 20 | 808 | M.583 (68-82), M.641 (106-120), M.649 (75-89), M.675 (161-175), M.678 (166-180) |
| TLTYEAVFQTTAVGL | 20 | 809 | M.499 (18-32), M.583 (123-137), M.641 (161-175), M.649 (130-144), M.675 (216-290), M.678 (221-235) |
| DKPVVAFIAGLTAPP | 20 | 810 | M.499 (90-104), M.583 (195-209), M.641 (233-247), M.649 (202-216), M.675 (228-302), M.678 (293-307) |
| KIKALREAGVTVVES | 20 | 811 | M.499 (125-139), M.583 (230-244), M.641 (266-282), M.649 (237-251), M.675 (323-337), M.678 (328-342) |
| GSTMFEIFKQRGMVE | 20 | 812 | M.499 (144-158), M.583 (249-263), M.641 (287-301), M.649 (256-270), M.675 (342-356), M.678 (347-361) |
| TVSDEYLAAVAKARR | 5 | 813 | M.421 (4-18), M.625 (15-29), M.631 (9-23), M.654 (5-19), M.655 (26-40), M.682 (4-18) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| LDIAVRLLEPIKEQV | 5 | 814 | M.393 (58-72), M.421 (71-85), M.618 (64-78), M.625 (82-96), M.631 (76-90), M.654 (72-86), M.655 (93-107), M.669 (58-72), M.682 (71-85) |
| IKEQVPILSYADFYQ | 5 | 815 | M.393 (68-82), M.421 (81-95), M.618 (74-88), M.625 (92-106), M.631 (86-100), M.654 (82-96), M.655 (103-117), M.669 (68-82), M.682 (81-95) |
| ILSYADFYQLAGVVA | 5 | 816 | M.393 (74-88), M.421 (87-101), M.618 (80-94), M.625 (98-112), M.631 (92-106), M.654 (88-102), M.655 (109-123), M.669 (74-88), M.682 (87-101) |
| FYQLAGVVAVEITGG | 5 | 817 | M.393 (80-94), M.421 (93-107), M.618 (86-100), M.625 (104-118), M.631 (98-112), M.654 (94-108), M.655 (115-129), M.669 (80-94), M.682 (93-107) |
| DHLRQVFTAQMGLSD | 5 | 818 | M.393 (123-137), M.421 (136-150), M.524 (30-44), M.618 (129-143), M.625 (147-161), M.631 (141-155), M.654 (137-151), M.655 (158-172), M.669 (123-137), M.682 (136-150) |
| NPLIFDNSYFTELLT | 5 | 819 | M.524 (73-87), M.618 (172-186), M.625 (190-204), M.631 (184-198), M.654 (180-194), M.655 (201-215), M.669 (166-180), M.682 (179-193) |
| EDAFFADYAEARLKL | 5 | 820 | M.524 (119-133), M.618 (218-232), M.625 (236-250), M.631 (230-244), M.654 (226-240), M.655 (247-261), M.669 (212-226), M.682 (225-239) |
| EDSHFVVELTYNYGV | 60 | 821 | M.509 (25-39) |
| RAIKFYEKAFGMELL | 60 | 822 | M.302 (38-52), M.484 (70-84), M.493 (35-49), M.497 (35-49), M.509 (121-135), M.515 (52-66), M.521 (35-49), M.533 (70-84) |
| NPQYKYTIAMMGYGP | 60 | 823 | M.302 (57-71), M.484 (89-103), M.493 (54-68), M.497 (54-68), M.509 (140-154), M.515 (71-85), M.521 (54-68), M.533 (89-103) |
| KNAVLELTYNYGVKE | 60 | 824 | M.302 (74-88), M.484 (106-120), M.493 (71-85), M.497 (71-85), M.509 (157-171), M.515 (88-102), M.521 (71-85), M.533 (106-120) |
| DGWKSVFVDNLDFLK | 60 | 825 | M.484 (172-185), M.493 (137-151), M.497 (137-151), M.515 (154-168), M.521 (137-151), M.533 (172-186) |
| EEAASTLPGLSSSTL | 37 | 826 | M.492 (4-18) |
| TLLFPHTQISLPSVR | 6 | 827 | M.639 (0-14) |
| VRTRKHLAATMADEK | 6 | 828 | M.639 (13-27) |
| DNEKSGFISLVSRYL | 6 | 829 | M.570 (7-21), M.639 (43-67) |
| FISLVSRYLSGEEEH | 6 | 830 | M.570 (13-27) |
| EATKALLNKLAVLKL | 6 | 831 | M.555 (11-25), M.639 (91-105) |
| IEVRNGFTFLDLIVL | 6 | 832 | M.546 (34-48), M.555 (42-56), M.570 (86-100), M.639 (122-136) |
| FLDLIVLQIESLNKK | 6 | 833 | M.546 (42-56), M.555 (50-64), M.570 (94-108), M.639 (130-144) |
| LNKKYGSNVPLLLMN | 6 | 834 | M.546 (53-67), M.555 (61-75), M.570 (105-119), M.639 (141-155) |
| NVPLLLMNSFNTHED | 6 | 835 | M.546 (60-74), M.555 (68-82), M.570 (112-126), M.639 (148-162) |
| LKIVEKYANSSIDIH | 6 | 836 | M.546 (76-90), M.555 (94-98), M.570 (128-142), M.639 (164-178) |
| SIDIHTFNQSQYPRV | 6 | 837 | M.546 (86-100), M.555 (94-105), M.570 (138-152), M.639 (174-188) |
| GKLDLLLSQGKEYVF | 6 | 838 | M.546 (135-149), M.555 (143-157), M.570 (187-201), M.639 (223-237) |
| GKEYVFIANSDNLGA | 6 | 839 | M.546 (144-158), M.555 (152-166), M.570 (196-210), M.639 (232-246) |
| SDNLGAIVDMKILNH | 6 | 840 | M.450 (4-18), M.546 (153-167), M.555 (161-175), M.570 (205-219), M.639 (241-255) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| IVDMKILNHLIHKQN | 6 | 841 | M.450 (10-24), M.546 (159-173), M.555 (167-181), M.570 (211-225), M.639 (247-261) |
| ISYEGRVQLLEIAQV | 6 | 842 | M.450 (44-58), M.546 (193-207), M.555 (201-215), M.570 (245-259), M.639 (281-295) |
| VQLLEIAQVPDAHVD | 6 | 843 | M.450 (50-64), M.546 (199-213), M.555 (207-271), M.570 (251-265), M.639 (287-301) |
| FKSIEKFKIFNTNNL | 6 | 844 | M.450 (66-80), M.546 (215-229), M.555 (223-237), M.639 (303-317) |
| FKIFNTNNLWVNLKA | 6 | 845 | M.450 (72-86), M.546 (221-235), M.555 (229-243), M.639 (309-323) |
| NNLWVNLKAIKRLVE | 6 | 846 | M.450 (78-92), M.546 (227-241), M.555 (235-249), M.639 (315-329) |
| IKRLVEADALKMEII | 6 | 847 | M.450 (87-101), M.546 (236-250), M.555 (244-258), M.639 (324-338) |
| VKVLQLETAAGAAIR | 6 | 848 | M.341 (4-18), M.342 (4-18), M.343 (4-18), M.450 (110-124) |
| AAIRFFDHAIGINVP | 6 | 849 | M.341 (15-29), M.342 (15-29), M.343 (15-29), M.450 (121-135) |
| GINVPRSRFLPVKAT | 6 | 850 | M.341 (25-39), M.342 (25-39), M.343 (25-39), M.450 (131-145) |
| RFLPVKATSDLQLVQ | 6 | 851 | M.341 (32-46), M.342 (32-46), M.343 (32-46), M.450 (138-152) |
| TSDLQLVQSDLYTLV | 6 | 852 | M.341 (39-53), M.342 (39-53), M.343 (39-53), M.450 (145-159) |
| VQSDLYTLVDGFVTR | 6 | 853 | M.341 (45-59), M.342 (45-59), M.343 (45-59), M.450 (151-165) |
| GPEFKKVGSFLGRFK | 6 | 854 | M.342 (74-88), M.343 (74-88) |
| GRFKSIPSIVELDSL | 6 | 855 | M.341 (85-99), M.342 (85-99), M.343 (85-99) |
| LQSKNCILYLCSIMI | 61 | 856 | M.478 (0-14) |
| ILYLCSIMICNCKVS | 61 | 857 | M.478 (6-20) |
| IMICNCKVSKVLNTY | 61 | 858 | M.478 (12-26) |
| KVSKVLNTYIFLLYL | 61 | 859 | M.478 (18-32) |
| GTIRNIINGTVFREP | 7 | 860 | M.658 (30-44) |
| VFNFTGAGGVALAMY | 7 | 861 | M.548 (7-21), M.560 (7-21), M.606 (17-31), M.628 (26-40), M.658 (100-114), M.695 (71-85) |
| IQGFAEASMAIAYEK | 7 | 862 | M.548 (27-41), M.560 (27-41), M.606 (37-51), M.628 (46-60), M.658 (120-134), M.695 (91-105) |
| ASMAIAYEKKWPLYL | 7 | 863 | M.548 (33-47), M.560 (33-47), M.606 (43-57), M.628 (52-66), M.658 (126-140), M.695 (97-111) |
| EKKWPLYLSTKNTIL | 7 | 864 | M.548 (40-54), M.560 (40-54), M.606 (50-64), M.628 (59-73), M.658 (133-147), M.695 (104-118) |
| GRFKDIFQAVYEADW | 7 | 865 | M.548 (59-73), M.560 (59-73), M.606 (69-83), M.628 (78-92), M.658 (152-166), M.695 (123-137) |
| WYEHRLIDDMVAYAL | 7 | 866 | M.248 (28-42), M.548 (83-97), M.560 (83-97), M.606 (93-107), M.628 (102-116), M.658 (176-190), M.695 (147-161) |
| VQSDFLAQGFGSLGL | 7 | 867 | M.248 (59-73), M.548 (114-128), M.560 (114-128), M.606 (124-138), M.628 (133-147), M/658 (207-221), M.695 (178-192) |
| NSIASIFAWTRGLAH | 7 | 868 | M.269 (2-16), M.328 (2-16), M.466 (25-39), M.548 (166-180), M.560 (166-180), M.606 (176-190), M.628 (185-199), M.658 (259-273), M.695 (230-244) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| DNARLLDFTQKLEDA | 7 | 869 | M.269 (22-36), M.328 (22-36), M.466 (45-59), M.548 (186-200), M.560 (186-200), M.606 (196-210), M.628 (205-219), M.658 (279-293), M.695 (250-264) |
| MTKDLALLVHGSSKV | 7 | 870 | M.269 (46-60), M.328 (46-60), M.466 (69-83), M.548 (210-224), M.560 (210-224), M.606 (220-234), M.628 (229-243), M.658 (303-317), M.695 (274-288) |
| LNTEEFIDAVAAELQ | 7 | 871 | M.269 (66-80), M.328 (66-80), M.466 (89-103), M.548 (230-244), M.560 (230-244), M.606 (240-254), M.628 (249-263), M.658 (323-337), M.695 (294-308) |
| NTRVLLLRRTSPFSA | 22 | 872 | M.615 (14-28) |
| DGYYIHGQCAIIMFD | 22 | 873 | M.352 (75-89), M.514 (75-89), M.539 (95-109), M.569 (88-102), M.578 (87-101), M.580 (84-88), M.587 (96-110), M.588 (97-111), M.594 (104-118), M.615 (123-137) |
| QCAIIMFDVTSRLTY | 22 | 874 | M.352 (82-96), M.514 (82-96), M.539 (102-116), M.569 (95-109), M.578 (94-108), M.580 (91-105), M.587 (103-117), M.588 (104-118), M.594 (111-125), M.615 (130-144) |
| RKKNLQYYEISAKSN | 22 | 875 | M.514 (138-152), M.539 (158-172), M.569 (151-165), M.578 (150-164), M.580 (147-161), M.587 (159-173), M.588 (160-174), M.594 (167-181), M.615 (186-200) |
| SAKSNYNFEKPFLYL | 22 | 876 | M.514 (148-162), M.539 (168-182), M.569 (161-175), M.578 (160-174), M.580 (157-171), M.587 (169-183), M.588 (170-184), M.594 (177-191), M.615 (196-210) |
| KPFLYLARKLAGDAN | 22 | 877 | M.514 (157-171), M.539 (177-191), M.569 (170-184), M.578 (169-183), M.580 (166-180), M.587 (178-192), M.588 (179-193), M.594 (188-200), M.615 (205-219) |
| ANIHFVEAVALKPPE | 22 | 878 | M.514 (170-184), M.539 (190-204), M.569 (183-197), M.578 (182-196), M.580 (179-193), M.587 (191-205), M.588 (192-206), M.594 (199-213), M.615 (218-232) |
| EAELAAAAAQPLPDD | 22 | 879 | M.514 (196-210), M.539 (216-230), M.569 (209-223), M.578 (208-222), M.580 (205-219), M.587 (217-231), M.588 (218-232), M.594 (225-239), M.615 (244-258) |
| YQPAAMRRLSLILLA | 62 | 880 | M.528 (10-24), M.529 (10-24), M.535 (10-24), M.543 (10-24), M.590 (10-24), M.691 (10-24) |
| RRLSLILLAAAALLA | 62 | 881 | M.528 (16-30), M.529 (16-30), M.535 (16-30), M.543 (16-30), M.590 (16-30), M.691 (16-30) |
| LLAAAALLAAAVSAE | 62 | 882 | M.510 (7-21), M.528 (22-36), M.529 (22-36), M.535 (22-36), M.543 (22-36), M.590 (22-36), M.691 (22-36) |
| CPRAERIIAEVVQSK | 62 | 883 | M.510 (37-51), M.528 (52-66), M.529 (52-66), M.535 (52-66), M.543 (52-66), M.590 (52-66), M.691 (22-66) |
| AFDAVVRSKLALELE | 62 | 884 | M.119 (44-58), M.222 (54-68), M.373 (37-51), M.510 (103-117), M.528 (118-132), M.529 (118-132), M.535 (118-132), M.543 (118-132), M.590 (118-132), M.691 (118-132) |
| CADILAIASRVLVTM | 62 | 885 | M.373 (58-72), M.510 (124-138), M.528 (139-153), M.529 (139-153), M.535 (139-153), M.543 (139-153), M.590 (139-153), M.691 (139-153) |
| NFTVGRIIELFTAKG | 62 | 886 | M.373 (103-117), M.528 (184-198), M.529 (184-198), M.535 (184-198), M.543 (184-198), M.590 (184-198), M.691 (184-198) |
| IIELFTAKGFTVQEM | 62 | 887 | M.373 (109-123), M.528 (190-204), M.529 (190-204), M.535 (190-204), M.543 (190-204), M.590 (190-204), M.691 (190-204) |
| FTVQEMVALSGAHTL | 62 | 888 | M.373 (118-132), M.529 (199-213), M.535 (199-213), M.543 (199-213), M.590 (199-213), M.691 (199-213) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| IAAFNDIMSSSVLSS | 62 | 889 | M.590 (263-277) |
| FDNIYSVNIERGLGL | 62 | 890 | M.691 (275-289) |
| NTDFFEDFAKAIEKL | 62 | 891 | M.691 (313-327) |
| TDTIVYCAGRTFFFR | 9 | 892 | M.547 (38-52), M.562 (55-69), M.761 (42-56) |
| GRTFFFRRLDAPLDA | 9 | 893 | M.547 (46-60), M.562 (63-77), M.761 (50-64) |
| KSLVRAFMWDSGSTV | 9 | 894 | M.547 (134-148), M.562 (151-165), M.571 (151-165), M.741 (44-58), M.761 (138-152) |
| RVLSCDFKPTRPFRI | 9 | 895 | M.547 (157-171), M.562 (174-188), M.571 (174-188), M.734 (50-64), M.738 (49-63), M.741 (67-81), M.761 (161-175) |
| HTGSIYAVSWSADSK | 9 | 896 | M.547 (242-256), M.562 (259-273), M.571 (259-273), M.734 (135-149), M.738 (134-148), M.741 (152-166), M.761 (246-260) |
| AGHLKTVSSLTYFPQ | 9 | 897 | M.597 (72-86), M.621 (45-59), M.651 (70-84), M.657 (81-95), M.677 (73-87), M.734 (224-238), M.738 (223-237), M.741 (241-255), M.761 (335-349) |
| VSSLTYFPQSNPRTM | 9 | 898 | M.597 (78-92), M.621 (51-65), M.651 (76-90), M.657 (87-101), M.677 (79-93), M.734 (230-244), M.738 (229-243), M.741 (247-261), M.761 (341-355) |
| SYDGVIIRWIQGVGY | 9 | 899 | M.597 (96-110), M.621 (69-83), M.651 (94-108), M.657 (105-119), M.677 (97-111), M.734 (248-262), M.738 (247-261), M.741 (265-279), M.761 (359-373) |
| TQIKCFVAAEEELIT | 9 | 900 | M.597 (120-134), M.621 (93-107), M.651 (118-132), M.657 (129-143), M.677 (121-135), M.734 (272-286), M.738 (271-285), M.741 (289-303), M.761 (383-397) |
| NALNIAVQQPEFALI | 9 | 901 | M.597 (164-178), M.621 (137-151), M.651 (162-176), M.657 (173-187), M.677 (165-179), M.734 (316-330), M.738 (315-329), M.741 (333-347), M.761 (427-441) |
| PEFALITTDSAIVLL | 9 | 902 | M.597 (173-187), M.621 (146-160), M.651 (171-185), M.657 (182-196), M.677 (174-188), M.734 (325-339), M.738 (324-338), M.741 (342-356), M.761 (436-450) |
| TDSAIVLLHKSTVTS | 9 | 903 | M.597 (180-194), M.621 (153-167), M.651 (178-192), M.657 (189-203), M.677 (181-195), M.734 (332-346), M.738 (331-345), M.741 (349-363), M.761 (443-457) |
| TKVSYTITSSAVSPD | 9 | 904 | M.597 (196-210), M.621 (169-183), M.651 (194-208), M.657 (205-219), M.677 (197-211), M.734 (348-362), M.738 (347-361), M.741 (365-379), M.761 (459-473) |
| KLRIYSISGDTLTEE | 9 | 905 | M.597 (222-236), M.621 (195-209), M.651 (220-234), M.657 (231-245), M.677 (223-237), M.734 (374-388), M.738 (373-387), M.741 (391-261), M.761 (485-499) |
| IHYSPDVSMFASADA | 9 | 906 | M.597 (249-263), M.621 (222-236), M.651 (247-261), M.657 (258-272), M.677 (250-264), M.734 (401-415), M.738 (400-414), M.741 (418-432), M.761 (512-526) |
| IKLKNMLFHTARINC | 9 | 907 | M.597 (277-291), M.621 (250-264), M.651 (275-289), M.657 (286-300), M.677 (278-292), M.734 (429-443), M.738 (428-442), M.741 (446-460), M.761 (540-554) |
| STKIFLESSTMESRA | 38 | 908 | M.709 (2-16) |
| CAAVLAASAVVVLVV | 38 | 909 | M.668 (7-21), M.709 (52-66) |
| VVVLVVASGLAGSRV | 38 | 910 | M.668 (16-30) |
| LAGSRVVRVAVDVAT | 38 | 911 | M.668 (25-39) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| GWYHLFYQYNPEGAV | 38 | 912 | M.584 (28-42), M.592 (28-42), M.599 (51-65), M.635 (73-87), M.647 (82-96), M.668 (113-127), M.686 (65-79), M.709 (158-172), M.760 (24-38) |
| SRDLIHWRHLPLAMV | 38 | 913 | M.584 (53-67), M.592 (53-67), M.599 (76-90), M.635 (98-112), M.647 (107-121), M.668 (138-152), M.686 (90-104), M.709 (183-197), M.760 (49-63) |
| LNMLYTGSTNASVQV | 38 | 914 | M.489 (7-21), M.584 (90-104), M.592 (90-104), M.599 (113-127), M.635 (135-149), M.647 (144-158), M.668 (175-189), M.686 (127-141), M.709 (220-234), M.760 (86-100) |
| IAMVYKTKDFVSYEL | 38 | 915 | M.417 (34-48), M.457 (2-16), M.486 (33-47), M.489 (88-102), M.495 (32-46), M.584 (171-185), M.592 (171-185), M.599 (194-208), M.635 (216-230), M.647 (225-239), M.668 (256-270), M.686 (208-222), M.709 (301-315), M.729 (34-48), M.760 (167-181) |
| TKDFVSYELIPGLLH | 38 | 916 | M.417 (40-54), M.457 (8-22), M.486 (39-53), M.489 (94-108), M.495 (38-52), M.584 (177-191), M.592 (177-191), M.599 (200-214), M.635 (222-236), M.647 (231-245), M.668 (262-276), M.686 (214-228), M.709 (307-321), M.729 (40-54), M.760 (173-187) |
| WGKFYASKTFYDPAK | 38 | 917 | M.417 (122-136), M.457 (90-104), M.486 (121-135), M.489 (176-190), M.495 (120-134), M.584 (259-273), M.592 (259-273), M.599 (282-296), M.635 (304-318), M.647 (313-327), M.668 (344-358), M.686 (296-310), M.709 (389-403), M.729 (122-136), M.760 (265-269) |
| KGWASLMSIPRTVDL | 38 | 918 | M.457 (125-139), M.486 (156-170), M.495 (155-169), M.686 (331-345), M.729 (157-171), M.760 (290-304) |
| LRHATQLDIEAAFRL | 38 | 919 | M.729 (212-226), M.760 (345-359) |
| EAAFRLDHAAVAALN | 38 | 920 | M.729 (221-235), M.760 (354-368) |
| EQTAVYFYVSRGLDG | 38 | 921 | M.729 (269-283), M.760 (402-435) |
| VKRVVGYTVPVLDGE | 38 | 922 | M.729 (303-317), M.760 (435-450) |
| EAFSVRVLVDHSIVE | 38 | 923 | M.729 (317-332), M.760 (450-464) |
| EAIYAAAGVYLFNNA | 38 | 924 | M.729 (349-363), M.760 (482-496) |
| VYLFNNATSGTVTVE | 38 | 925 | M.729 (357-371), M.760 (490-504) |
| TDIVEVVSPPYVFL | 39 | 926 | M.415 (6-20), M.464 (41-55), M.467 (24-38), M.520 (40-54) |
| SPPYVFLPTVKDKLR | 39 | 927 | M.415 (14-28), M.464 (49-63), M.467 (32-46), M.520 (48-62) |
| GAFTGEVSAEMLANL | 39 | 928 | M.415 (44-58), M.464 (79-93), M.467 (62-76), M.494 (33-47), M.520 (78-92) |
| VSAEMLANLGIPWVI | 39 | 929 | M.415 (50-64), M.464 (85-99), M.520 (84-98) |
| GESSEFVGDKVAYAL | 39 | 930 | M.410 (21-35), M.415 (75-89), M.464 (110-124), M.467 (93-107), M.494 (64-78), M.520 (109-123) |
| GDKVAYALAQGLKVI | 39 | 931 | M.392 (2-16),M.410 (28-42), M.415 (82-96),M.458 (0-14), M.464 (117-131), M.467 (100-114), M.494 (71-85), M.520 (116-130) |
| STMTVVAEQTKAIAD | 39 | 932 | M.347 (23-37),M.374 (18-32), M.392 (30-44),M.410 (56-70), M.415 (110-124), M.458 (28-42), M.464 (145-159), M.467 (128-142), M.494 (99-113), M.520 (144-158) |
| DWTNVVIAYEPVWAI | 39 | 933 | M.347 (41-55),M.374 (36-50), M.392 (48-62),M.410 (74-88), M.415 (128-142), M.458 (46-60), M.464 (163-177), M.467 (146-160), M.494 (117-131), M.520 (162-176) |
| IAYEPVWAIGTGKVA | 39 | 934 | M.347 (47-61),M.374 (42-56), M.392 (54-68),M.410 (80-94), M.415 (134-148), M.458 (52-66), M.464 (169-183), M.467 (152-166), M.494 (123-137), M.520 (168-182) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| LKPEFIDIINAATVK | 39 | 935 | M.374 (116-130), M.458 (126-140), M.494 (197-211) |
| RTSSWGSGASLKIDR | 23 | 936 | M.419 (0-14), M.443 (0-14) |
| SLKIDRRELVTTRIY | 23 | 937 | M.419 (9-23), M.443 (9-23) |
| RFLHAAVAMATKRSV | 24 | 938 | M.540 (10-24), M.640 (8-22), M.642 (8-22), M.645 (18-32) |
| KGKKVFLRADLNVPL | 24 | 939 | M.540 (33-47), M.622 (16-30), M.626 (16-30), M.627 (21-35), M.640 (31-45), M.642 (31-45), M.645 (41-55), M.646 (32-46), M.650 (34-48), M.652 (34-48) |
| TRIRASIPTIKFLLE | 24 | 940 | M.540 (57-71), M.581 (10-24), M.622 (40-54), M.626 (40-54), M.627 (45-59), M.640 (55-69), M.642 (55-69), M.645 (65-79), M.646 (56-70), M.650 (58-72), M.652 (58-72) |
| TIKFLLEKGAKVILA | 24 | 941 | M.540 (65-79), M.581 (18-32), M.622 (48-62), M.626 (48-62), M.627 (53-67), M.640 (63-77), M.642 (63-77), M.645 (73-87), M.646 (64-78), M.650 (66-80), M.652 (66-80) |
| EKGAKVILASHLGRP | 24 | 942 | M.540 (71-85), M.581 (24-38), M.622 (54-68), M.626 (54-68), M.627 (59-73), M.640 (69-83), M.642 (69-83), M.645 (79-93), M.646 (70-84), M.650 (72-86), M.652 (72-86) |
| VPRLSELLGVEVVMA | 24 | 943 | M.540 (98-112), M.559 (17-31), M.565 (22-36), M.567 (22-36), M.581 (51-65), M.622 (81-95), M.626 (81-95), M.627 (86-100), M.640 (96-110), M.642 (96-110), M.645 (106-120), M.646 (97-111), M.650 (99-113), M.652 (99-113) |
| GGVLLLENVRFYKEE | 24 | 944 | M.540 (130-144), M.559 (49-63), M.565 (54-68), M.567 (54-68), M.581 (83-97), M.622 (113-127), M.626 (113-127), M.627 (118-132), M.640 (128-142), M.642 (128-142), M.645 (138-152), M.646 (129-143), M.650 (131-145), M.652 (131-145) |
| PEFAKKLASVADLYV | 24 | 945 | M.540 (149-163), M.559 (68-82), M.565 (73-87), M.567 (73-87), M.581 (102-116), M.622 (132-146), M.626 (132-146), M.627 (137-151), M.640 (147-161), M.642 (147-161), M.645 (157-171), M.646 (148-162), M.650 (150-164), M.652 (150-164) |
| KFLRPSVAGFLMQKE | 24 | 946 | M.540 (182-196), M.559 (101-115), M.565 (106-120), M.567 (106-120), M.581 (135-149), M.622 (165-179), M.626 (165-179), M.627 (170-184), M.640 (180-194), M.642 (180-194), M.645 (190-204), M.646 (181-195), M.650 (183-197), M.652 (183-197) |
| VAGFLMQKELDYLVG | 24 | 947 | M.540 (188-202), M.559 (107-121), M.565 (112-126), M.567 (112-126), M.581 (141-155), M.622 (171-185), M.626 (171-185), M.627 (176-190), M.640 (186-200), M.642 (186-200), M.645 (196-210), M.646 (187-201), M.650 (189-203), M.652 (189-203) |
| KELDYLVGAVANPKK | 24 | 948 | M.540 (195-209), M.559 (114-128), M.565 (119-133), M.567 (119-133), M.581 (148-162), M.622 (178-192), M.626 (178-192), M.627 (183-197), M.640 (193-207), M.642 (193-207), M.645 (203-217), M.646 (194-208), M.650 (196-210), M.652 (196-210) |
| KIGVIESLLAKVDIL | 24 | 949 | M.540 (223-237), M.559 (142-156), M.565 (147-161), M.567 (147-161), M.581 (176-190), M.622 (206-220), M.626 (206-220), M.627 (211-225), M.640 (221-235), M.642 (221-235), M.645 (231-245), M.646 (222-236), M.650 (224-238), M.652 (224-238) |
| GMIFTFYKAQGKAVG | 24 | 950 | M.559 (161-175), M.565 (166-180), M.567 (166-180), M.581 (195-209), M.622 (225-239), M.626 (225-239), M.627 (230-244), M.640 (240-254), M.642 (240-254), M.645 (250-264), M.646 (241-255), M.650 (243-257), M.652 (243-257) |
| EEDKLELATSLIETA | 24 | 951 | M.559 (180-194), M.565 (185-199), M.567 (185-199), M.581 (214-228), M.622 (244-258), M.626 (244-258), M.627 (249-263), M.640 (259-273), M.642 (259-273), M.645 (269-283), M.646 (260-274), M.650 (262-276), M.652 (262-276) |
| GVSLLLPTDVVVADK | 24 | 952 | M.559 (198-212), M.565 (203-217), M.567 (203-217), M.581 (232-246), M.622 (262-276), M.626 (262-276), M.627 (267-281), M.640 (277-291), |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| | | | M.642 (277-291), M.645 (287-301), M.646 (278-292), M.650 (280-294), M.652 (280-294) |
| SAPALRILRSFPSHS | 25 | 953 | M.609 (1-15) |
| VELVAVNDPFITTDY | 26 | 954 | M.255 (1-15), M.471 (1-15), M.496 (1-15), M.575 (1-15) |
| DYMTYMFKYDTVHGQ | 26 | 955 | M.255 (14-28), M.471 (14-28), M.496 (14-28), M.575 (14-28), M.586 (8-22) |
| GGAKKVIISAPSKDA | 26 | 956 | M.471 (89-103), M.496 (89-103), M.575 (89-103),M.586 (83-97) |
| YTSDITIVSNASCTT | 26 | 957 | M.471 (115-129), M.496 (115-129), M.575 (115-129),M.586 (109-123) |
| KVINDRFGIVEGLMT | 26 | 958 | M.471 (137-151), M.496 (137-151), M.575 (137-151),M.586 (131-145) |
| FGIVEGLMTTVHAMT | 26 | 959 | M.471 (143-157), M.496 (143-157), M.575 (143-157),M.586 (137-151) |
| GGRAASFNIIPSSTG | 26 | 960 | M.367 (15-29), M.471 (173-187), M.496 (173-187), M.575 (173-187), M.586 (167-181) |
| LTVRLEKAATYEQIK | 26 | 961 | M.367 (62-76), M.575 (220-234), M.586 (214-228) |
| ALNDNFVKLVSWYDN | 26 | 962 | M.182 (43-57), M.189 (38-52), M.283 (50-64), M.297 (43-57), M.586 (271-285) |
| VWQHDRVEIIANDQG | 40 | 963 | M.118 (1-15) |
| VEIIANDQGNRTTPS | 40 | 964 | M.118 (7-21) |
| TTPSYVAFTDSERLI | 40 | 965 | M.118 (18-32) |
| KNQVAMNPINTVFGE | 40 | 966 | M.118 (37-51) |
| NPINTVFGEHLSTCT | 40 | 967 | M.118 (43-57) |
| SSTRGWCSRRAGRG | 41 | 968 | M.346 (0-14) |
| EEKQFAAEEISSMVL | 42 | 969 | M.318 (16-30) |
| SSMVLIKMREIAEAF | 42 | 970 | M.318 (26-40) |
| SIKNAVVTVPAYFND | 42 | 971 | M.318 (44-58) |
| GVIAGLNVLRIINEP | 42 | 972 | M.318 (68-82) |
| VLRIINEPTAAAIAY | 42 | 973 | M.318 (75-89) |
| GRYFSKDAVQIITKM | 10 | 974 | M.177 (9-23) |
| DAVQIITKMAAANGV | 10 | 975 | M.177 (15-29) |
| GVRRVWVGQDSLLST | 10 | 976 | M.177 (28-42) |
| SLLSTPAVSAIIRER | 10 | 977 | M.177 (38-52) |
| AVSAIIRERIAADGS | 10 | 978 | M.177 (44-58) |
| YPSMLLILLLLHGAN | 63 | 979 | M.408 (4-18), M.432 (4-18), M.477 (4-18) |
| ILLLLHGANAALDEP | 63 | 980 | M.361 (5-19), M.408 (10-24), M.432 (10-24),M.477 (10-24) |
| ESSLYAYQFAMSNGL | 63 | 981 | M.361 (45-59), M.408 (50-64), M.432 (50-64),M.477 (50-64) |
| SGLRLDKSTLIAEVF | 63 | 982 | M.361 (80-94), M.408 (85-99), M.432 (85-99),M.477 (85-99) |
| IHGWFAVDFTAAELV | 63 | 983 | M.361 (108-122), M.408 (113-127), M.432 (113-127),M.477 (113-127) |
| IGKRFASINVENVED | 27 | 984 | M.469 (45-59) |
| ALRELLFTTPGALQH | 27 | 985 | M.469 (63-77) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| LQHISGVILFEETLY | 27 | 986 | M.469 (75-89) |
| YEAGARFAKWRAVLK | 27 | 987 | M.104 (18-32),M.469 (143-157) |
| GLARYAIICQENGLV | 27 | 988 | M.206 (26-40),M.469 (174-188), M.472 (10-24) |
| RCAYVTEVVLAACYK | 27 | 989 | M.206 (57-71),M.472 (41-55) |
| NDQHVLLEGSLLKPN | 27 | 990 | M.472 (58-72) |
| WFLSFSFGRALQQST | 27 | 991 | M.294 (68-80),M.314 (61-75), M.472 (135-149) |
| SVGFVETLENDLAQL | 11 | 992 | M.372 (57-71), M.466 (7-21), M.513 (56-70),M.579 (35-49), M.593 (50-64) |
| LGEAPYKFKSALEAV | 11 | 993 | M.372 (110-124), M.395 (25-39), M.446 (60-74),M.506 (30-44), M.513 (109-123), M.579 (88-102), M.593 (103-117) |
| KFKSALEAVKTLRAE | 11 | 994 | M.372 (116-130), M.395 (31-45), M.446 (66-80),M.513 (115-129), M.579 (94-108), M.593 (109-123) |
| QYLPAFVIVDESGKS | 11 | 995 | M.395 (51-65), M.446 (86-100), M.506 (56-70),M.513 (135-149), M.579 (114-128), M.593 (129-143) |
| VVTFNFRADRMVMLA | 11 | 996 | M.381 (2-16), M.388 (2-16), M.391 (2-16),M.395 (75-89), M.446 (110-124), M.506 (80-94),M.513 (159-173), M.579 (138-152), M.593 (153-167) |
| ADRMVMLAKALEFAD | 11 | 997 | M.381 (9-23), M.388 (9-23), M.391 (9-23),M.395 (82-96), M.446 (117-131), M.506 (87-101),M.513 (166-180), M.579 (145-159), M.593 (160-174) |
| FDKFDRVRVPKIKYA | 11 | 998 | M.381 (24-38), M.391 (24-38),M.395 (97-111), M.446 (132-146), M.506 (102-116),M.513 (181-195), M.579 (160-174), M.593 (175-189) |
| PKIKYAGMLQYDGEL | 11 | 999 | M.381 (33-47), M.388 (33-47), M.391 (33-47),M.395 (106-120), M.446 (141-155), M.506 (111-125),M.513 (190-204), M.579 (169-183), M.593 (184-198) |
| LKLPNKFLVSPPLIE | 11 | 1000 | M.381 (47-61), M.388 (47-61), M.391 (47-61),M.395 (120-134), M.446 (155-169), M.506 (125-139),M.513 (204-218), M.579 (183-197), M.593 (198-212) |
| GILLDFVWYEPLTYN | 43 | 1001 | M.523 (0-14) |
| ETMQRLVADRLPNFT | 43 | 1002 | M.479 (11-25), M.519 (40-54), M.523 (43-57),M.600 (40-54) |
| GYSKWLYVVPWGFYK | 43 | 1003 | M.371 (12-26), M.380 (12-26), M.438 (43-57),M.461 (62-76), M.479 (81-95), M.480 (12-26),M.482 (12-26), M.519 (110-124), M.523 (113-127), M.556 (62-76),M.600 (110-124) |
| YVVPWGFYKAVMHVK | 43 | 1004 | M.371 (18-32), M.380 (18-32), M.438 (49-63),M.461 (68-82), M.479 (87-101), M.480 (18-26),M.482 (18-32), M.519 (116-130), M.523 (119-133), M.556 (68-82),M.600 (116-130) |
| KFRIDYFDQYLHELK | 43 | 1005 | M.108 (6-20), M.254 (5-19), M.260 (9-19),M.253 (6-20), M.371 (62-76), M.380 (62-76), M.438 (93-107), M.461 (112-126), M.479 (131-145), M.480 (62-76), M.482 (62-76), M.519 (160-174), M.523 (163-177), M.556 (112-126),M.600 (160-174) |
| ARVTGYFAWSLLDNF | 43 | 1006 | M.108 (27-41), M.254 (26-40), M.260 (26-40),M.261 (27-41), M.371 (83-97), M.380 (83-97), M.438 (114-128), M.461 (113-147), M.479 (152-166), M.480 (83-97),M.482 (83-97), M.519 (181-195), M.523 (184-198), M.556 (133-147),M.600 (181-195) |
| FAWSLLDNFEWRMGF | 43 | 1007 | M.108 (33-47), M.254 (32-46), M.260 (32-46),M.261 (33-47), M.371 (89-103), M.380 (89-103), M.438 (120-134), M.461 (139-153), M.479 (158-172), M.480 (89-103),M.482 (89-103), M.519 (187-201), M.523 (190-204), M.556 (139-153),M.600 (187-201) |
| EIPTISYSDLYQLAG | 64 | 1008 | M.568 (15-29),M.589 (16-30) |

TABLE 2-continued

Panel of peptides predicted from protein sequences identified by transcriptomic anaylsis of Timothy Grass (TG) pollen.

| peptide_sequence (SEQ ID NOS:621-1442) | Prot. ID | SEQ ID | ORF (start-stop) |
|---|---|---|---|
| YSDLYQLAGVVAVEV | 64 | 1009 | M.568 (21-35), M.589 (22-36) |
| DHLRQVFGKQMGLSD | 64 | 1010 | M.412 (5-19), M.516 (21-35), M.522 (5-19), M.568 (67-81), M.589 (68-82) |
| KNPLKFDNTYFTELL | 64 | 1011 | M.412 (47-61), M.462 (20-34), M.516 (63-77), M.522 (47-61), M.568 (109-123), M.589 (110-124) |
| KAFFEDYKEAHLRLS | 64 | 1012 | M.412 (95-109), M.462 (68-82), M.516 (111-125), M.522 (95-109), M.568 (157-171), M.589 (158-172) |
| YKLLCSSFPVITYHQ | 12 | 1013 | M.525 (4-18), M.656 (4-18) |
| FPVITYHQGRNGNLS | 12 | 1014 | M.525 (11-25), M.656 (11-25) |
| RNGNLSALACPLNQK | 12 | 1015 | M.525 (20-34), M.619 (20-34), M.656 (20-34) |
| IPPAPHLKRWNRVVD | 28 | 1016 | M.420 (1-15), M.444 (1-15) |
| LKRWNKVVDTNLESP | 28 | 1017 | M.420 (7-21), M.444 (7-21) |
| VVDTNLESPNDIVPE | 28 | 1018 | M.420 (13-27), M.444 (13-27) |
| GAPFTGSGYRIAPYS | 28 | 1019 | M.420 (28-42), M.444 (28-42) |
| GYRIAPYSSILLKAT | 28 | 1020 | M.420 (35-49), M.444 (35-49) |
| ECILSGLLSVDGLKV | 13 | 1021 | M.620 (15-29), M.630 (16-30), M.698 (16-30), M.599 (16-30) |
| LLSVDGLKVLHMDRN | 13 | 1022 | M.620 (21-35), M.630 (22-36), M.698 (22-36), M.699 (22-36), M.708 (0-14) |
| VPKFMMANGALVRVL | 13 | 1023 | M.620 (75-89), M.630 (76-90), M.698 (76-90), M.699 (76-90), M.708 (54-68) |
| VRVLIRTSVTKYLNF | 13 | 1024 | M.620 (86-100), M.630 (87-101), M.698 (87-101), M.699 (87-101), M.708 (65-79) |
| TKYLNFKAVDGSFVY | 13 | 1025 | M.620 (95-109), M.630 (96-100), M.698 (96-100), M.699 (96-100), M.708 (74-88) |
| TDVEALKSNLMGLFE | 13 | 1026 | M.620 (120-134), M.630 (121-135), M.698 (121-135), M.699 (121-135), M.708 (99-113) |
| EKRRARKFFIYVQDY | 13 | 1027 | M.620 (134-148), M.630 (135-149), M.698 (134-149), M.699 (134-149), M.708 (113-127) |
| KFFIYVQDYEEEDPK | 13 | 1028 | M.620 (140-154), M.630 (141-155), M.698 (141-155), M.699 (141-155), M.708 119-133) |
| TVDFIGHALAHRDD | 13 | 1029 | M.439 (14-28), M.620 (179-193), M.630 (180-194), M.698 (180-194), M.699 (180-194), M.708 (158-172) |
| VKRMKLYAESLARFQ | 13 | 1030 | M.439 (39.53), M.620 (204-218), M.630 (205-219), M.698 (205-219), M.708 (183-197) |
| GELPQAFARLSAVYG | 13 | 1031 | M.439 (66.80), M.620 (231-245), M.630 (232-245), M.598 (232-246), M.699 (232-246), M.708 (210-224) |
| FARLSAVYGGTYMLN | 13 | 1032 | M.439 (72-86), M.620 (237-251), M.630 (238-252), M.698 (238-252), M.699 (238-252), M.708 (216-230) |
| KGKFIAFVSTEAETD | 13 | 1033 | M.698 (347-361), M.699 (347-361), M.708 (325-339) |
| ETTVKDVLALYSKIT | 13 | 1034 | M.708 (390-404) |
| LDLSVDLNAASAGES | 13 | 1035 | M.708 (408-422) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| FKDDPYIYAFDSLKY | 44 | 1036 | M.400 (65-79), M.401 (20-34), M.409 (6-20), M.435 (6-20), M.470 (59-73), M.474 (65-79), M.490 (65-79), M.491 (65-79), M.537 (6.20), M.553 (6.20) |
| AFDSLKYIGIELWQV | 44 | 1037 | M.400 (73-87), M.401 (28-42), M.409 (14-28), M.435 (14-28), M.470 (57-81), M.474 (73-87), M.490 (79-87), M.491 (73-87), M.537 (14-28), M.553 (14-28) |
| IELWQVKSGTLFDNI | 44 | 1038 | M.400 (82.96), M.401 (37-81), M.409 (23-37), M.435 (23-37), M.470 (76-90), M.474 (82.96), M.490 (82.96), M.491 (82.96), M.537 (23-37), M.553 (23-37) |
| GTLFDNILITDDAAL | 44 | 1039 | M.400 (90-104), M.401 (45-59), M.409 (31-45), M.435 (31-45), M.470 (84-98), M.474 (90-104), M.490 (90-104), M.491 (90-104), M.537 (31-45), M.553 (31-45) |
| ILITDDAALAKTFAE | 44 | 1040 | M.400 (96-100), M.401 (51-65), M.409 (37-51), M.435 (37-51), M.470 (90-104), M.474 (96-110), M.490 (96-110), M.491 (96-110), M.537 (37-51), M.553 (37-51) |
| KRPPRCCQDLVVLPL | 45 | 1041 | M.402 (4-38), M.538 (4-18), M.594 (4-18) |
| RGLLRRARGGPHHRR | 46 | 1042 | M.234 (2-16), M.237 (2-16), M.264 (2-16) |
| RGAHRRVPLRPLRHR | 46 | 1043 | M.234 (18-32), M.237 (18-32), M.264 (18-32) |
| EGRRAKLRSAGEVEI | 46 | 1044 | M.234 (39-53), M.237 (39-53), M.264 (39-53) |
| GEVEIQFRRVKCKYP | 46 | 1045 | M.234 (49-63), M.237 (49-63), M.264 (49-63) |
| TKVTFHVVGVGPLLH | 46 | 1046 | M.237 (66-80) |
| EDVAVSLAKYTAELS | 47 | 1047 | M.549 (14-28), M.550 (14-28), M.551 (14-28), M.557 (14-28), M.563 (24-38), M.566 (25-39), M.573 (14-28) |
| GKFAAERGAFTVVLS | 47 | 1048 | M.463 (36-50), M.549 (29-43), M.550 (29-43), M.551 (29-43), M.557 (29-43), M.558 (35-49), M.563 (39-53), M.566 (40-54), M.573 (29-43) |
| AFTVVLSGGTLIDTL | 47 | 1049 | M.463 (44-58), M.551 (37-51), M.557 (37-51), M.558 (43-57), M.566 (48-62), M.573 (37-51) |
| DSNYKLAVDGLLSKV | 47 | 1050 | M.463 (91-105), M.532 (40-54), M.549 (84-98), M.550 (84-98), M.551 (84-98), M.557 (84-98), M.558 (90-104), M.563 (94-108), M.566 (95-109), M.573 (84-98) |
| TVLKQLVKSGVLAMS | 47 | 1051 | M.463 (130-144), M.550 (123-137), M.551 (123-137), M.558 (129-143), M.563 (133-147), M.566 (134-148) |
| KSGVLAMSTATGFPR | 47 | 1052 | M.463 (137-151), M.550 (130-144), M.551 (130-144), M.558 (136-150), M.563 (140-154), M.566 (141-155) |
| PPPQRITFTFPVIKS | 47 | 1053 | M.532 (140-154), M.549 (184-198), M.550 (184-198), M.551 (184-198), M.557 (184-198), M.558 (190-204), M.563 (194-208), M.565 (195-209), M.573 (184-198) |
| TFTFPVIKSSAYVAM | 47 | 1054 | M.532 (146-160), M.549 (190-204), M.550 (190-204), M.551 (190-204), M.557 (190-204), M.558 (196-210), M.563 (200-214), M.566 (201-215), M.573 (190-204) |
| KTLPLLPTEMAILQD | 47 | 1055 | M.532 (179-193), M.549 (223-237), M.550 (223-237), M.551 (223-237), M.557 (223-237), M.558 (229-243), M.563 (233-247), M.566 (234-248), M.573 (223-237) |
| NKLIGARSFFESAKW | 48 | 1056 | M.247 (1-15), M.517 (0-14) |
| RAHIAFYQVCFEQKG | 48 | 1057 | M.247 (64-78), M.517 (63-77), M.684 (0-14), M.739 (0-14) |
| AALNGVFVSTAAGNI | 48 | 1058 | M.517 (122-136), M.684 (5-73), M.730 (45-59), M.732 (57-71), M.736 (45-59), M.737 (45-59), M.739 (59-73) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| APWLLTVGASTSDRR | 48 | 1059 | M.517 (147-161), M.684 (84-98), M.730 (70-84), M.732 (82-96), M.736 (70-84), M.737 (70-84), M.739 (84-98) |
| STSDRRFAATVKLGS | 48 | 1060 | M.517 (156-170), M.684 (93-107), M.711 (2-16), M.712 (4-18), M.730 (79-93), M.732 (91-105), M.736 (79-93), M.737 (79-93), M.739 (93-107) |
| VLRAGAFGMIVVAPA | 48 | 1061 | M.684 (170-184), M.711 (79-93), M.712 (81-95), M.732 (168-182), M.736 (156-170), M.739 (170-184) |
| FGMIVVAPAVFGPVI | 48 | 1062 | M.637 (0-14), M.684 (176-190), M.711 (85-99), M.712 (87-101), M.730 (162-176), M.732 (174-188), M.736 (162-176), M.737 (162-176), M.739 (176-190) |
| YAVGQKIKAYLEAES | 48 | 1063 | M.637 (28-42), M.684 (204-238), M.711 (113-127), M.712 (115-129), M.730 (190-204), M.732 (202-216), M.736 (190-204), M.737 (190-204), M.739 (204-218) |
| VPGVVDIVLQPKEVM | 48 | 1064 | M.637 (94-108), M.712 (181-195), M.730 (256-270), M.732 (268-282), M.736 (256-270), M.737 (256-270) |
| CPHLAGIAALLKNAH | 48 | 1065 | M.637 (121-135), M.684 (297-311), M.711(206-220), M.712 (208-222), M.730 (283-297), M.732 (295-309), M.736 (283-297), M.737 (283-297), M.739 (297-311) |
| GLVYNLTAAEYIPYL | 48 | 1066 | M.637 (188-202), M.684 (364-378), M.711 (273-287), M.712 (275-289), M.730 (350-364), M.732 (362-376), M.736 (350-364), M.737 (350-364), M.739 (364-378) |
| KADSVVNASRAVTNV | 48 | 1067 | M.637 (246-260), M.711 (331-345), M.712 (333-347), M.730 (408-422), M.732 (420-434), M.736 (408-422), M.737 (408-422), M.739 (422-436) |
| KLTFKALEEVLNYTV | 48 | 1068 | M.637 (285-299), M.711 (370-384), M.712 (372-386), M.730 (447-461), M.732 (459-473), M.736 (447-461), M.737 (447-461), M.739 (461-475) |
| EEVLNYTVTVKTAAV | 48 | 1069 | M.637 (292-306), M.711 (377-391), M.712 (379-393), M.730 (454-468), M.732 (456-480), M.736 (454-468), M.737 (454-468), M.739 (468-482) |
| IEGQLKWVSSKHIVR | 48 | 1070 | M.637 (311-325), M.711 (396-410), M.712 (398-412), M.736 (473-487), M.737 (473-487), M.739 (487-501) |
| WVSSKHIVRSPILIL | 48 | 1071 | M.637 (317-331), M.711 (402-416), M.712 (404-418), M.736 (479-493), M.737 (479-493), M.739 (493-507) |
| SFRFFLAHSSIHPST | 29 | 1072 | M.707 (0-14), M.710 (1-15) |
| EKHFKYVILGGGVAA | 29 | 1073 | M.702 (14-28), M.707 (24-38), M.710 (25-39), M.713 (19-33) |
| TEKGIELILSTEIVK | 29 | 1074 | M.638 (70-84), M.673 (49-63), M.683 (63-77), M.687 (70-84), M.697 (70-84), M.700 (68-82), M.702 (94-108), M.707 (104-118), M.710 (105-119), M.713 (99-113) |
| ASKTLTSAAGATFTY | 29 | 1075 | M.638 (88-302), M.673 (67-81), M.683 (81-95), M.687 (88-102), M.697 (88-102), M.700 (86-100), M.702 (112-326), M.707 (122-136), M.710 (123-137), M.713 (117-131) |
| FTYETLLIATGSSTI | 29 | 1076 | M.638 (100-114), M.673 (79-93), M.683 (93-107), M.687 (100-114), M.697 (100-114), M.700 (98-112), M.702 (124-138), M.707 (134-148), M.710 (135-149), M.713 (129-143) |
| GGGYIGLELSAALKL | 29 | 1077 | M.638 (157-171), M.673 (136-150), M.683 (150-164), M.687 (157-171), M.697 (157-171), M.700 (155-169), M.702 (181-195), M.707 (191-205), M.710 (192-206), M.713 (186-200) |
| LELSAALKLNNFDVT | 29 | 1078 | M.638 (163-177), M.673 (142-156), M.683 (156-170), M.687 (163-177), M.697 (163-177), M.700 (161-175), M.702 (187-201), M.707 (197-211), M.710 (198-212), M.713 (192-206) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| LKLNNFDVTMVYPEP | 29 | 1079 | M.638 (169-183), M.673 (148-162), M.683 (162-176), M.687 (169-183), M.697 (169-183), M.700 (167-181), M.702 (193-207), M.707 (203-217), M.710 (204-218), M.713 (198-212) |
| MPRLFTAGIAHFYEG | 29 | 1080 | M.638 (186-200), M.673 (165-179), M.683 (179-193), M.687 (186-200), M.697 (186-200), M.700 (184-198), M.702 (210-224), M.707 (220-234), M.710 (221-235), M.713 (215-229) |
| HFYEGYYASKGINIV | 29 | 1081 | M.638 (196-210), M.873 (175-189), M.687 (196-210), M.697 (196-210), M.700 (194-208), M.702 (220-234), M.707 (230-244), M.710 (233-245), M.713 (225-239) |
| SKGINIVKGTVASGF | 29 | 1082 | M.638 (204-218), M.673 (183-197), M.687 (204-218), M.697 (204-218), M.700 (202-216), M.702 (228-242), M.707 (238-252), M.710 (239-253), M.713 (233-247) |
| DANIVIVGVGGRPLT | 29 | 1083 | M.638 (238-252), M.673 (217-231), M.683 (231-245), M.687 (238-252), M.697 (238-252), M.700 (236-250), M.702 (262-276), M.707 (272-286), M.710 (273-287), M.713 (267-281) |
| KTDTFFETSVAGVYA | 29 | 1084 | M.638 (267-281), M.673 (246-260), M.683 (260-274), M.687 (267-281), M.697 (267-281), M.700 (265-279), M.702 (291-305), M.707 (301-315), M.710 (302-316), M.713 (296-310) |
| VYAIGDVASFPMKLY | 29 | 1085 | M.638 (279-293), M.673 (258-272), M.683 (272-286), M.687 (279-293), M.697 (279-293), M.700 (277-291), M.702 (303-317), M.707 (313-327), M.710 (314-328), M.713 (308-322) |
| DYLPYFYSRSFDIAW | 29 | 1086 | M.638 (329-343), M.673 (308-322), M.683 (322-336), M.687 (329-343), M.697 (329-343), M.700 (327-341), M.702 (353-367), M.707 (363-377), M.710 (364-378), M.713 (358-372) |
| LLGYLLWVVAIRRPR | 14 | 1087 | M.746 (0-34), M.758 (0.14), M.762 (0.14), M.764 (0.14) |
| WVVAIRRPRPVRCFS | 14 | 1088 | M.746 (6-20), M.758 (6-20), M.762 (6-20), M.764 (6-20) |
| EQFVTPWSFSVASGH | 30 | 1089 | M.608 (17-31), M.643 (19-33), M.663 (17-31), M.664 (17-31), M.666 (17-31), M.670 (17-31), M.731 (19-33), M.735 (19-33), M.740 (14-28), M.748 (19-33), M.750 (19-33), M.752 (18-32), M.754 (18-32), M.756 (18-32) |
| RDAHYLRGLLPPAIV | 30 | 1090 | M.608 (50-64), M.643 (52-66), M.663 (50-64), M.664 (50-64), M.666 (50-64), M.670 (50-64), M.731 (52-66), M.735 (52-66), M.740 (47-61), M.748 (52-66), M.750 (52-66), M.752 (51-65), M.754 (51-65), M.756 (51-65) |
| MHNLRQYTVPLQRYI | 30 | 1091 | M.608 (74-88), M.643 (76-90), M.663 (74-88), M.664 (74-88), M.666 (74.88), M.670 (74-88), M.731 (76-90), M.735 (76-90), M.740 (71-85), M.748 (76-90), M.750 (76-90), M.752 (75-89), M.754 (75-89), M.756 (75-89) |
| VPLQRYIAMMDLQER | 30 | 1092 | M.608 (82-96), M.643 (84-98), M.663 (82-96), M.664 (82-96), M.666 (82-96), M.670 (82-96), M.731 (84-98), M.735 (84-98), M.740 (79-93), M.748 (84-98), M.750 (84-98), M.752 (83-97), M.754 (83-97), M.756 (83-97) |
| ERLFYKLLIDNVEEL | 30 | 1093 | M.608 (98-112), M.643 (100-114), M.663 (98-112), M.664 (98-112), M.666 (98-112), M.670 (98-112), M.731 (100-114), M.735 (100-114), M.740 (95-109), M.748 (100-114), M.750 (100-114), M.752 (99-113), M.754 (99-113), M.756 (99-113) |
| EELLPVVYTPVVGEA | 30 | 1094 | M.608 (110-124), M.643 (112-126), M.663 (110-124), M.664 (110-124), M.666 (110-124), M.670 (110-124), M.731 (112-126), M.735 (112-126), M.740 (107-121), M.748 (112-126), M.750 (112-126), M.752 (111-125), M.754 (111-125), M.756 (111-125) |
| RSIQVIVVTDGERIL | 30 | 1095 | M.608 (158-172), M.643 (160-174), M.663 (158-172), M.664 (158-172), M.666 (158-172), M.670 (158-172), M.731 (160-174), M.735 (160-174), M.740 (155-169), M.748 (160-174), M.750 (160-174), M.752 (159-173), M.754 (159-173), M.756 (159-173) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| EEYHELLQEFMNAVK | 30 | 1096 | M.608 (234-248), M.643 (236-250), M.663 (234-248), M.664 (234-248), M.666 (234-248), M.670 (234-248), M.731 (236-250), M.735 (236-250), M.740 (231-245), M.748 (236-250), M.750 (236-250), M.752 (235-249), M.754 (235-249), M.756 (235-249) |
| GEKVLVQFEDFANHN | 30 | 1097 | M.608 (252-266), M.643 (254-268), M.663 (252-266), M.664 (252-266), M.666 (252-266), M.670 (252-266), M.731 (254-268), M.735 (254-268), M.740 (249-263), M.748 (254-268), M.750 (254-268), M.752 (253-267), M.754 (253-267), M.756 (253-267) |
| FDLLAKYSKSHLVFN | 30 | 1098 | M.608 (268-282), M.643 (270-284), M.663 (268-282), M.664 (268-282), M.666 (268-282), M.260 (268-282), M.731 (270-284), M.735 (270-284), M.740 (265-279), M.748 (270-284), M.750 (270-284), M.752 (269-283), M.754 (269-283), M.756 (269-283) |
| VFNDDIQGTASVVLA | 30 | 1099 | M.608 (280-294), M.643 (282-296), M.663 (280-294), M.664 (280-294), M.666 (280-294), M.670 (280-294), M.731 (282-296), M.735 (282-296), M.740 (277-291), M.748 (282-296), M.750 (282-296), M.752 (281-295), M.754 (281-295), M.756 (281-295) |
| SVVLAGLLAALKVIG | 30 | 1100 | M.643 (292-306), M.663 (290-304), M.664 (290-304), M.666 (290-304), M.670 (290-304), M.731 (292-306), M.735 (292-306), M.740 (287-301), M.748 (292-306), M.750 (292-306), M.752 (291-305), M.754 (291-305), M.756 (291-305) |
| GLADQTYLFLGAGEA | 30 | 1101 | M.643 (308-322), M.663 (306-320), M.664 (306-320), M.666 (306-320), M.670 (306-320), M.731 (308-322), M.735 (308-322), M.740 (303-317), M.748 (308-322), M.750 (308-322), M.752 (307-323), M.754 (307-321), M.756 (307-321) |
| TGIAELIALEMSKHT | 30 | 1102 | M.643 (324-338), M.663 (322-336), M.664 (322-336), M.666 (322-336), M.670 (322-336), M.731 (324-338), M.735 (324-338), M.740 (319-333), M.748 (324-338), M.750 (324-338), M.752 (323-337), M.754 (323-337), M.756 (323-337) |
| CRKKIWLVDSKGLLV | 30 | 1103 | M.731 (345-359), M.735 (345-359), M.740 (340-354), M.748 (345-359), M.750 (345-359), M.752 (344-358), M.754 (344-358), M.755 (344-358) |
| HEPLTTLLEAVQSLK | 30 | 1104 | M.731 (377-391), M.735 (377-391), M.740 (372-386), M.748 (377-391), M.750 (377-391), M.752 (376-390), M.754 (376-390), M.756 (376-390) |
| LLEAVQSLKPTVLIG | 30 | 1105 | M.731 (383-397), M.735 (383-397), M.740 (378-392), M.748 (383-397), M.750 (383-397), M.752 (382-396), M.754 (382-396), M.756 (382-396) |
| NEKPVIFSLSNPTSH | 30 | 1106 | M.731 (417-431), M.735 (417-431), M.740 (412-426), M.748 (417-431), M.750 (417-431), M.752 (416-430), M.754 (416-430), M.756 (416-430) |
| EEAYTWTKGTAVFAS | 30 | 1107 | M.731 (437-451), M.735 (437-451), M.740 (432-446), M.748 (437-451), M.750 (437-451), M.752 (436-450), M.754 (438-450), M.756 (436-450) |
| GFGLGVVISGAIRVH | 30 | 1108 | M.735 (478-492), M.740 (473-487), M.748 (478-492), M.750 (478-492), M.752 (477-491), M.754 (477-491), M.756 (477-491) |
| VISGAIRVHDDMLLA | 30 | 1109 | M.735 (484-498), M.740 (479-493), M.748 (484-498), M.750 (484-498), M.752 (483-497), M.754 (483-497), M.756 (483-497) |
| HDDMLLAASEALAEQ | 30 | 1110 | M.735 (492-506), M.740 (487-501), M.748 (492-506), M.750 (492-506), M.752 (491-505), M.754 (491-505), M.756 (491-505) |
| FPPFTNIRKISANIA | 30 | 1111 | M.740 (513-527), M.748 (518-532), M.750 (518-532), M.752 (517-531), M.754 (517-531), M.756 (517-531) |
| IRKISANIAAKVAAK | 30 | 1112 | M.748 (524-538), M.750 (524-538), M.752 (523-537), M.754 (523-537), M.754 (523-537) |
| PRVNFFKRYNLTCVF | 15 | 1113 | M.716 (0-14), M.726 (0-14) |
| KRYNLTCVFWSKKKK | 15 | 1114 | M.726 (6-20) |
| TIVASGIENMKIFTR | 8 | 1115 | M.763 (5-19), M.765 (2-16) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| FSCDSAYQVTYTVRG | 65 | 1116 | M.171 (10-24), M.205 (6-20), M.256 (21-35), M.332 (2-16) |
| YQVTYIVRGSGRVQV | 65 | 1117 | M.148 (4-38), M.171 (16-30), M.205 (32-25), M.255 (27-41), M.332 (8-22), M.64 (0-14) |
| IEGGSLFIVPRFHVV | 65 | 1118 | M.148 (31-45), M.171 (43-57), M.205 (39-53), M.22 (19-33), M.256 (54-68), M.332 (35-49), M.4 (16-30), M.55 (23-37), M.56 (16-30), M.64 (27-41) |
| GMEWFSIITTPNFIF | 65 | 1119 | M.332 (57-71), M.58 (38-52) |
| GKTSVWKAISPEVLE | 65 | 1120 | M.332 (76-90) |
| ELRKTYNLLDAVSRH | 48 | 1121 | M.43 (0-14), M.47 (0-14), M.61 (0-14) |
| QVYPRSWSAVMLTFD | 49 | 1122 | M.32 (13-27), M.43 (17-31), M.47 (17-31), M.57 (6-20), M.61 (17-31) |
| AVMLTFDNAGMWNVR | 49 | 1123 | M.13 (5-19), M.32 (21-35), M.43 (25-39), M.47 (25-39), M.57 (14-28), M.61 (25-39) |
| NVWERHYLAGEMTLM | 49 | 1124 | M.32 (37-51), M.47 (41-55) |
| GEQLYISVISPARSL | 49 | 1125 | M.33 (29-43), M.57 (38-52) |
| DSSEYAFRTAVSSSM | 50 | 1126 | M.518 (9-23) |
| IGNLRLDNTTLIDKD | 50 | 1127 | M.538 (43-57) |
| EIPMIQNILSRSQIF | 50 | 1128 | M.518 (87-101) |
| SRSQIFDGIPNLMSL | 50 | 1129 | M.518 (96-110) |
| DGIPNLMSLDNVVKI | 50 | 1130 | M.518 (102-116) |
| IWVNVEYDSFYREHG | 50 | 1131 | M.518 (122-136) |
| EFPVTWVSSPEVALL | 50 | 1132 | M.518 (149-163) |
| SPEVALLKSLAGKLR | 50 | 1133 | M.518 (157-171) |
| AGKLRNSTKLIFRFL | 50 | 1134 | M.518 (167-181) |
| STKLIFRFLREDLVE | 50 | 1135 | M.518 (173-187) |
| GELLKDLKSIKAFAS | 50 | 1136 | M.518 (195-209) |
| LKSIKAFASGILVPK | 50 | 1137 | M.538 (201-215) |
| CEGILKLLETHLVPS | 51 | 1138 | M.267 (9-23), M.270 (14-28) |
| LLETHLVPSSTAPES | 51 | 1139 | M.267 (15-29), M.270 (20-34) |
| PESKVFYLKMKGDYH | 51 | 1140 | M.267 (27-41), M.270 (32-46) |
| MNSYKAAQDIALADL | 51 | 1141 | M.150 (38-52), M.267 (81-75), M.270 (66-80), M.73 (23-37) |
| APTHPIRLGLALKIS | 51 | 1142 | M.73 (38-52) |
| LLGLLAPLASAQLSR | 52 | 1143 | M.505 (0-14), M.667 (0-14), M.679 (0-14), M.680 (0-14) |
| PDAEKIVAAVIEKKL | 52 | 1144 | M.488 (4-18), M.505 (22-36), M.667 (22-36), M.679 (22-36), M.680 (22-36) |
| AGLLRLLFHDCFANG | 52 | 1145 | M.488 (26-40), M.505 (44-58), M.667 (44-58), M.679 (44-58), M.680 (44-58) |
| CDASILIDPLSNQSA | 52 | 1146 | M.230 (1-15), M.445 (9-23), M.488 (41-55), M.505 (59-73), M.667 (59-73), M.679 (59-73), M.680 (59-73) |

TABLE 2-continued

Panel of peptides predicted from protein sequences identified by
transcriptomic anaylsis of Timothy Grass (TG) pollen.

| peptide_sequence (SEQ ID NOS:621-1442) | Prot. ID | SEQ ID | ORF (start-stop) |
|---|---|---|---|
| IDSSYFANYLAKKMP | 52 | 1147 | M.530 (104-118), M.667 (228-242), M.679 (228-242), M.680 (228-242) |
| KPNDFMPTFAKAMEK | 52 | 1148 | M.530 (141-155), M.667 (265-279), M.679 (265-279), M.680 (265-279) |
| PTFAKAMEKLSVLKV | 52 | 1149 | M.530 (147-161), M-679 (271-285), M.680 (271-285) |
| GGSVIRISSANPEDL | 52 | 1150 | M.530 (184-198), M.667 (308-322), M.679 (308-322), M.680 (308-322) |
| DPWHVKTLKAAGAAH | 52 | 1151 | M.530 (218-232), M.667 (342-385), M.679 (342-356), M.680 (342-356) |
| WSEIQTLKPNLIGPF | 53 | 1152 | M.436 (0-14), N.534 (0-14) |
| KFMTLAGFLDYAKAS | 53 | 1153 | M.436 (30-44), M.487 (29-43), M.508 (27-41), M.534 (30-44), M.613 (29-43), M.688 (28-42) |
| NISGILIGIEHAAYL | 53 | 1154 | M.436 (45-59), M.487 (44-58), M.508 (42-56), M.534 (45-59), M.613 (44-58), M.688 (43-57) |
| AAYLATRGLDVVDAV | 53 | 1155 | M.436 (56-70), M.487 (55-69), M.508 (53-67), M.534 (56-70), M.562(10-24), M.572 (1-15), M.613 (55-69), M.688(54-68) |
| GLDVVDAVSNALIKS | 53 | 1156 | M.436 (63-77), M.487 (62-76), M.508 (60-74), M.534 (63-77), M.552 (17-31), M.572 (8-22), M.613 (62-76), M.688 (61-75) |
| TKQQVFIQSEDPPVL | 53 | 1157 | M.336 (19-33), M.436 (83-97), M.487 (82-96), M.508 (80-54), M.534 (83-97), M.552 (37-51), M.572 (28-42), M.613 (82-96) M.688 (81-95) |
| PVLSAFKKFPKFNRV | 53 | 1158 | M.336 (31-45), M.436 (95-109), M.487 (94-108), M.508 (92-106), M.534 (95-109), M.552 (49-63), M.572 (40-54), M.613 (94-108), M.688 (93-107) |
| KFPKFNRVFEIEFDI | 53 | 1159 | M.336 (38-52), M.436 (102-116), M.487 (101-115), M.508 (89-113), M.534 (102-116), M.552 (56-70), M.572 (47-61), M.613 (101-115), M.688 (100-114) |
| VEIKEFANAVKLRRS | 53 | 1160 | M.336 (61-75), M.436 (125-139), M.487 (124-138), M.508 (122-136), M.534 (125-139), M.552 (79-93), M.572 (70-84), M.613 (124-138), M.688 (123-137) |
| VKLRRSSAAQVDGFY | 53 | 1161 | M.336 (70-84), M.436 (114-146), M.487 (133-147), M.508 (131-145), M.534 (134-148), M.552 (88-102), M.572 (79-93), M.613 (133-147), M.688 (132-146) |
| GFYLTGFNAVVERLR | 53 | 1162 | M.336 (82-96), M.436 (146-160), M.487 (145-159), M.508 (143-157), M.534 (146-160), M.552 (100-114), M.572 (91-105), M.613 (145-159), M.688 (144-158) |
| GVLKNEFMSLAFDYW | 53 | 1163 | M.487 (168-182), M.508 (166-180), M.534 (169-183), M.552 (123-137), M.572 (114-128), M.613 (168-182), M.668 (167-181) |
| GLVTEFPSTAAAYFR | 53 | 1164 | M.534 (201-215), M.552 (155-169), M.572 (146-160), M.613 (200-214), M.688 (199-213) |
| NIVVNVFNQLDQPLL | 54 | 1165 | M.384 (38-52) |
| QPLLFTWNGIQHRKN | 54 | 1166 | M.384 (49-63) |
| IGSFFYFPSIGMQRT | 54 | 1167 | M.127 (12-26), M.145 (12-126), M.147 (36-80), M.213 (26-39), M.220 (25-39), M.384 (92-106) |
| GYGLISVVSRLLIPV | 54 | 1168 | M.127 (29-43), M.145 (29-43), M.147 (33-47), M.213 (42-26), M.220 (42-56), M.384 (109-123) |
| VVSRLLIPVPFDPPA | 54 | 1169 | M.127 (35-49), M.145 (35-49), M.213 (48-62), M.220 (48-62), M.384 (115-128) |
| VCTRLSPFCCLYCIL | 17 | 1170 | M.577 (1-15), M.717 (1-15), M.719 (1-15), M.724 (1-15), M.727 (1-15) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| YCILCCWYSMRLVTV | 17 | 1171 | M.577 (12-26), M.717 (12-26), M.719 (12-26), M.724 (12-26), M.727 (12-26) |
| NIWADDLAASLSTLE | 76 | 1172 | MN.169 (10-24) |
| IAIAFLSVSNNYEYI | 76 | 1173 | MN.124 (0-14) |
| VSNNYEYILSDKLVV | 76 | 1174 | MN.124 (7-21) |
| KDKLVVSTSCSLMHT | 76 | 1175 | MN.169 (32-46) |
| TSCSLMHTAVDLVNE | 76 | 1176 | MN.124 (23-37), MN.169 (39-53) |
| TKLDSEIKSWLAFAA | 76 | 1177 | MN.124 (38-52), MN.169 (54-68) |
| IKSWLAFAAQKVVEV | 76 | 1178 | MN.124 (44-58), MN.169 (60-74) |
| KVVEVNALGKALVGL | 76 | 1179 | MN.124 (54-68), MN.169 (70-84) |
| LKDEAYFAANAAAQA | 76 | 1180 | MN.124 (68-82), MN.169 (84-98) |
| EAYVSAIKEEISKVV | 76 | 1181 | MN.124 (158-172), MN.169 (174-188), MN.82 (13-37) |
| ISKVVKIQEELDIDV | 76 | 1182 | MN.124 (168-182), MN.169 (184-198), MN.82 (23-37) |
| MVEYFGEQLSGFAFT | 76 | 1183 | MN.169 (209-223), MN.82 (48-62) |
| LSGFAFTANGWVQSY | 76 | 1184 | MN.169 (217-221), MN.82 (56-70) |
| NPMTVFWSKMAQSMT | 76 | 1185 | MN.169 (249-263), MN.82 (88-102) |
| EGPLMLYVSKMIPAS | 77 | 1186 | MN.206 (2-16), MN.210 (2-16) |
| KGRFFAFGRVFAGRV | 77 | 1187 | MN.208 (18-32), MN.210 (18-32) |
| GNTVALVGLDQFITK | 77 | 1188 | MN.206 (78-92), MN.210 (78-92) |
| VGLDQFITKNATLTG | 77 | 1189 | MN.206 (84-98), MN.210 (84-98) |
| PIRAMKFSVSPVVRV | 77 | 1190 | MN.206 (106-120), MN.210 (106-120) |
| FMGGAEIIVSPPVVS | 77 | 1191 | MN.201 (49-63), MN.206 (178-192), MN.210 (178-192) |
| SPPVVSFRETVLDKS | 77 | 1192 | MN.201 (58-72), MN.206 (187-201), MN.210 (187-201) |
| NKHNRLYMEARPLEE | 77 | 1193 | MN.201 (82-96), MN.206 (213-225), MN.210 (211-225) |
| PTARRVIFASQLTAK | 77 | 1194 | MN.136 (42-56), MN.140 (49-63), MN.173 (68-82), MN.183 (102-116), MN.184 (102-116), MN.185 (94-108), MN.193 (101-115), MN.201 (208-222), MN.206 (337-351), MN.210 (337-351) |
| AKPRLLEPVYLVEIQ | 77 | 1195 | MN.136 (55-69), MN.140 (62-76), MN.173 (81-95), MN.183 (135-129), MN.184 (115-129), MN.185 (107-121), MN.193 (114-128), MN.201 (221-235), MN.206 (350-364), MN.210 (350-364) |
| EPVYLVEIQAPEGAL | 77 | 1196 | MN.136 (61-75), MN.140 (68-82), MN.173 (87-101), MN.183 (121-135), MN.184 (121-135), MN.185 (113-127), MN.193 (120-134), MN.201 (227-241), MN.206 (356-370), MN.210 (356-370) |
| PLYNIKAYLPVIESF | 77 | 1197 | MN.136 (99-113), MN.140 (106-120), MN.173 (125-139), MN.183 (159-173), MN.184 (159-173), MN.185 (191-169), MN.193 (158-172), MN.201 (265-279), MN.206 (394-408), MN.210 (394-408) |
| LPVIESFGFSATLRA | 77 | 1198 | MN.136 (107-121), MN.140 (114-128), MN.173 (133-147), MN.183 (167-181), MN.184 (167-181), MN.185 (159-173), MN.193 (166-180), MN.201 (273-287), MN.206 (402-416), MN.210 (402-416) |
| FGFSATLRAATSGQA | 77 | 1199 | MN.136 (113-127), MN.140 (120-134), MN.173 (139-153), MN.183 (173-187), MN.184 (173-187), MN.185 (165-179), MN.193 (172-185), MN.201 (229-293), MN.206 (408-422), MN.210 (408-422) |

TABLE 2-continued

Panel of peptides predicted from protein sequences identified by
transcriptomic anaylsis of Timothy Grass (TG) pollen.

| peptide_sequence (SEQ ID NOS:621-1442) | Prot. ID | SEQ ID | ORF (start-stop) |
|---|---|---|---|
| SLKLHKACEAFNPYD | 78 | 1200 | MN.12 (4-18) |
| EAFDPYYGKISLSKV | 78 | 1201 | MN.15 (32-25), MN.38 (27-41) |
| SKVRSFLTEAKAKHI | 78 | 1202 | MN.12 (24-38), MN.15 (24-38), MN.35 (39-53), MN.38 (39-53), MN.41 (40-54) |
| LTEAKAKHIEWNCDV | 78 | 1203 | MN.12 (30-44), MN.15 (30-44), MN.3 (13-27), MN.35 (45-59), MN.38 (45-59), MN.41 (46-60), MN.47 (47-61) |
| KEKRWNAALTSISAS | 78 | 1204 | MN.86 (64-78) |
| GSAYVDLGSLLAERT | 78 | 1205 | MN.86 (81-95) |
| RHLARQFIPHLHQRF | 78 | 1206 | MN.83 (0-14), MN.94 (0-14) |
| FIPHLHQRFIHPPIH | 78 | 1207 | MN.83 (6-20), MN.94 (6-20) |
| NTMENLSSTIFSFVI | 78 | 1208 | MN.14 (1-15), MN.33 (10-24), MN.46 (22-36), MN.74 (0-14), MN.83 (23-37), MN.94 (23-37) |
| TIFSFVILLSASASL | 78 | 1209 | MN.14 (9-23), MN.17 (6-20), MN.20 (6-20), MN.30 (12-26), MN.33 (18-32), MN.46 (30-44), MN.67 (6-20), MN.74 (8-22), MN.8 (1-19), MN.83 (31-45), MN.94 (31-45) |
| ILLSASAELVVAGDP | 78 | 1210 | MN.14 (15-29), MN.17 (12-26), MN.20 (12-26), MN.30 (18-32), MN.33 (24-38), MN.45 (36-50), MN.67 (12-26), MN.8 (7-21), MN.83 (37-51), MN.94 (37-51) |
| ELAEMEVSAAFHLTS | 78 | 1211 | MN.51 (32-46), MN.56 (32-46), MN.59 (32-46), MN.62 (32-46), MN.63 (32-46), MN.67 (59-73), MN.74 (61-75), MN.86 (32-46), MN.94 (84-98) |
| SAAFHLFSMAVTAAR | 78 | 1212 | MN.51 (39-53), MN.56 (39-53), MN.59 (39-53), MN.62 (39-53), MN.63 (39-53), MN.67 (66-80), MN.74 (68-82), MN.86 (39-53) |
| FSMAVTAARSQQWND | 78 | 1213 | MN.51 (45-59), MN.56 (49-59), MN.59 (45-59), MN.62 (45-59), MN.63 (45-59), MN.67 (72-86), MN.74 (74-88), MN.86 (45-59) |
| KISLSKVRSFLTEAK | 78 | 1214 | MN.12 (20-34), MN.15 (20-34), MN.35 (35-49), MN.38 (35-49), MN.41 (36-50) |
| QQYTAALSPILFECL | 79 | 1215 | MN.108 (131-145) |
| LSPILFECLIHPMLG | 79 | 1216 | MN.106 (5-19), MN.90 (5-19), MN.96 (5-19) |
| VEDNLVKLKNVLNVY | 79 | 1217 | MN.90 (27-41), MN.91 (0-14), MN.96 (27-41) |
| KLKNVLNVYEARLTK | 79 | 1218 | MN.106 (33-47), MN.80 (4-18), MN.81 (1-15), MN.90 (33-47), MN.91 (6-20), MN.96 (33-47) |
| EVYEARLTKFNYLAG | 79 | 1219 | MN.36 (5-19), MN.26 (4-18) |
| TKFKYLAGDYLSLAD | 79 | 1220 | MN.36 (12-26), MN.76 (11-25), MN.81 (14-28), MN.90 (46-60) |
| AGDYLSLADLNHVST | 79 | 1221 | MN.106 (52-56), MN.35 (18-32), MN.76 (17-31), MN.80 (23-37), MN.81 (20-34), MN.90 (52-66), MN.91 (25-39), MN.95 (52-66) |
| VKAWWTDLLAKPSVQ | 79 | 1222 | MN.106 (85-99), MN.36 (51-65), MN.71 (25-39), MN.76 (50-64), MN.80 (56-70), MN.81 (53-67), MN.90 (85-99), MN.91 (58-72), MN.96 (85-99) |
| KLRFTCLSSTGSSCL | 80 | 1223 | MN.186 (0-14) |
| LSSTGSSCLFVLILF | 80 | 1224 | MN.186 (6-20) |
| EKLKKVLEVYEARLS | 81 | 1225 | MN.58 (0-14) |
| SYLAGDFVSFADLNH | 81 | 1226 | MN.58 (17-31) |

TABLE 2-continued

Panel of peptides predicted from protein sequences identified by transcriptomic anaylsis of Timothy Grass (TG), pollen.

| peptide_sequence (SEQ ID NOS:621-1442) | Prot. ID | SEQ ID | ORF (start-stop) |
|---|---|---|---|
| FVSFADLNHFPKTFY | 81 | 1227 | MN.58 (23-37) |
| FPKTFYFMATPHASL | 81 | 1228 | MN.58 (32-46) |
| HVKAWWERIMARPAV | 81 | 1229 | MN.58 (52-66) |
| IMARPAVKKIAAAMV | 81 | 1230 | MN.58 (60-74) |
| KRKVRGFWRVHQISA | 82 | 1231 | MN.107 (32-46) |
| FWRVHQISARMAPVK | 82 | 1232 | MN.107 (38-52) |
| MAPVKLYGATLSWNV | 82 | 1233 | MN.107 (48-62) |
| GDLYIFESRAICKYA | 82 | 1234 | MN.107 (108-122), MN.6 (17-31), MN.77 (39-53) |
| EANQYTAALGPILFE | 82 | 1235 | MN.107 (149-163), MN.77 (80-94) |
| ACSLFLNYAVSFNYF | 83 | 1236 | MN.205 (4-18), MN.211 (4-18) |
| YAVSFNYFVCNLLQE | 83 | 1237 | MN.205 (11-25), MN.211 (11-25) |
| NLLQERLKKLKSEHG | 83 | 1238 | MN.205 (21-35), MN.211 (21-35) |
| GMTGMLWETSLLDPE | 83 | 1239 | MN.203 (27-43), MN.204 (27-41), MN.205 (53-67), MN.211 (53-67) |
| PEGLLWLLLTGKVPT | 83 | 1240 | MN.203 (69-83), MN.204 (69-83), MN.205 (95-109), MN.211 (95-109), |
| YVYKAIDALPVTAHP | 83 | 1241 | MN.203 (103-117), MN.204 (103-117), MN.205 (129-143), MN.211 (129-143) |
| QFTTGVMALQVESEF | 83 | 1242 | MN.203 (120-134), MN.204 (120-134), MN.205 (146-160), MN.211 (145-160) |
| EDCLNLIARLPQVAS | 83 | 1243 | MN.203 (153-167), MN.204 (153-167), MN.205 (179-193), MN.211 (179-193) |
| IARLPQVASYVYRRI | 83 | 1244 | MN.203 (159-173), MN.204 (159-173), MN.205 (185-199), MN.211 (185-199) |
| ADNSLDYAANFSHML | 83 | 1245 | MN.203 (182-196), MN.204 (182-196), MN.205 (208-222), MN.211 (208-222) |
| DPKMLELMRLYITIH | 83 | 1246 | MN.203 (200-214), MN.204 (200-214), MN.205 (226-240), MN.211 (226-240) |
| ALSDPYLSFAAALNG | 83 | 1247 | MN.203 (233-247), MN.204 (238-247), MN.205 (259-273), MN.211 (259-273) |
| LSFAAALNGLAGPLH | 83 | 1248 | MN.203 (239-253), MN.204 (239-253), MN.205 (265-279), MN.211 (265-279) |
| PLHGLANQEVLLWIK | 83 | 1249 | MN.203 (251-265), MN.204 (251-265), MN.205 (277-291), MN.211 (277-291) |
| QEVLLWIKSVMEETG | 83 | 1250 | MN.203 (258-272), MN.204 (258-272), MN.205 (184-298), MN.211 (284-298) |
| QLKEYVWKTLKSGKV | 83 | 1251 | MN.203 (279-293), MN.204 (279-293), MN.205 (905-319), MN.211 (909-319) |
| EDPLFQLVSKLYEVV | 83 | 1252 | MN.123 (17-31), MN.203 (322-336), MN.204 (322-336), MN.205 (348-362), MN.211 (348-362), MN.69 (0-14), MN.98 (17-31) |
| LVSKLYEVVFGILTE | 83 | 1253 | MN.123 (23-37), MN.203 (328-342), MN.204 (328-342), MN.205 (354-368), MN.211 (364-368), MN.69 (6-20), MN.98 (23-37) |
| SGVLLNHFGLVEARY | 83 | 1254 | MN.113 (28-42), MN.123 (52-66), MN.203 (357-371), MN.204 (357-371), MN.205 (383-397), MN.211 (383-397), MN.68 (28-42), MN.69 (35-49), MN.93 (28-42), MN.98 (52-66) |
| TVLFGVSRSMGIGSQ | 83 | 1255 | MN.113 (44-58), MN.123 (68-82), MN.203 (979-387), MN.204 (373-387), MN.205 (399-419), MN.211 (399-413), MN.68 (44-58), MN.69 (51-65), MN.93 (44-58), MN.98 (68-82) |
| GSQLIWDRALGLPLE | 83 | 1256 | MN.113 (56-70), MN.123 (80-94), MN.203 (385-399), MN.204 (385-399), MN.205 (411-425), MN.211 (411-425), MN.68 (56-70), MN.69 (63-77), MN.93 (56-70), MN.98 (80-94) |
| GPVTILNWSFVRNDQ | 84 | 1257 | MN.105 (9-23), MN.166 (5-19), MN.167 (6-20), MN.172 (9-23), MN.178 (9-23), MN.182 (5-19) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| PRFETCYQIALAIKK | 84 | 1258 | MN.105 (24-38), MN.166 (20-34), MN.167 (21-35), MN.168 (10-24), MN.172 (24-38), MN.178 (24-38), MN.182 (20-34) |
| GIQVIQIDEAALREG | 84 | 1259 | MN.105 (47-61), MN.166 (43-57), MN.167 (44-58), MN.168 (33-47), MN.172 (47-61), MN.178 (47-61), MN.182 (43-57) |
| EHAFYLDWAVHSFRI | 84 | 1260 | MN.105 (68-82), MN.166 (64-78), MN.167 (65-79), MN.168 (54-68), MN.172 (68-82), MN.178 (68-82), MN.182 (64-78) |
| FNDIIHSIINMDADV | 84 | 1261 | MN.105 (102-115), MN.166 (98-112), MN.167 (99-113), MN.168 (88-102), MN.172 (102-316), MN.178 (302-115), MN.182 (98-112) |
| SDEKLLSVFREGVTY | 84 | 1262 | MN.105 (124-138), MN.166 (120-134), MN.167 (121-135), MN.168 (110-124), MN.172 (124-138), MN.178 (124-138), MN.182 (120-134) |
| VNKMLAVLDTNILWV | 84 | 1263 | MN.166 (160-174), MN.167 (161-175), MN.168 (150-164), MN.172 (164-178), MN.178 (164-178), MN.182 (160-174) |
| TRKYAEVMPALTNMV | 84 | 1264 | MN.166 (182-196), MN.167 (183-197), MN.168 (172-186), MN.172 (186-200), MN.178 (186-200), MN.182 (182-196) |
| PALTNMVTAAKLIRT | 84 | 1265 | MN.166 (190-204), MN.167 (191-205), MN.168 (180-194), MN.172 (194-208), MN.178 (194-208), MN.182 (190-204) |
| VTAAKLIRTQLASTK | 84 | 1266 | MN.166 (196-210), MN.167 (197-211), MN.168 (186-200), MN.172 (200-214), MN.178 (200-214), MN.182 (196-210) |
| GRGIKDFGLVVAPGQ | 85 | 1267 | MN.39 (9-23) |
| LTVGNIIAGDRFSMA | 85 | 1268 | MN.39 (28-42) |
| DRFSMAYDRTPEEIL | 85 | 1269 | MN.39 (37-51) |
| YDRTPEEILAIVYGT | 85 | 1270 | MN.39 (43-57) |
| EILAIVYGIGNPAQA | 85 | 1271 | MN.39 (49-63) |
| TREENVYMAKLAEQA | 86 | 1272 | MN.102 (6-20), MN.116 (6-20), MN.117 (6-20), MN.181 (6-20), MN.194 (6-20), MN.195 (6-20), MN.202 (6-20) |
| YEEMVEFMEKVAKTA | 86 | 1273 | MN.102 (23-37), MN.116 (23-37), MN.117 (23-37), MN.156 (11-25), MN.181 (23-37), MN.194 (23-37), MN.195 (23-37), MN.202 (23-37) |
| EERNLLSVAYKNVIG | 86 | 1274 | MN.102 (45-59), MN.116 (45-59), MN.117 (45-59), MN.156 (33-47), MN.181 (45-59), MN.194 (45-59), MN.195 (45-59), MN.202 (45-59) |
| AYKNVIGARRASWRI | 86 | 1275 | MN.102 (53-67), MN.116 (53-67), MN.117 (53-67), MN.156 (41-55), MN.181 (53-67), MN.194 (53-67), MN.195 (53-67), MN.202 (53-67) |
| RRASWRIISSIEQKE | 86 | 1276 | MN.102 (61-75), MN.116 (61-75), MN.117 (61-75), MN.156 (49-63), MN.181 (61-75), MN.194 (61-75), MN.195 (61-75), MN.202 (61-75) |
| NEAYVASIKEYRTRI | 86 | 1277 | MN.101 (10-24), MN.102 (80-94), MN.116 (80-94), MN.117 (80-94), MN.156 (68-82), MN.181 (80-94), MN.194 (80-94), MN.195 (80-94), MN.202 (80-94) |
| SKICDGILKLLDSHL | 86 | 1278 | MN.101 (29-43), MN.102 (99-113), MN.116 (99-113), MN.117 (99-113), MN.156 (87-101), MN.181 (99-113), MN.194 (99-113), MN.195 (99-113), MN.202 (99-113) |
| ILKLLDSHLVPSATA | 86 | 1279 | MN.101 (35-49), MN.102 (105-119), MN.116 (105-119), MN.117 (105-119), MN.156 (93-107), MN.181 (105-119), MN.194 (105-119), MN.195 (105-119), MN.202 (105-119) |
| AESKVFYLKMKGDYH | 86; 51 | 1280 | (4-18), MN.101 (50-64), MN.102 (120-134), MN.116 (120-134), MN.117 (120-134), MN.156 (108-122), MN.181 (120-134), MN.194 (120-134), MN.195 (120-134), MN.202 (120-134) |
| GDYHRYLAEFKAGAE | 86 | 1281 | MN.101 (61-75), MN.116 (131-145), MN.156 (119-139), MN.183 (131-145), MN.194 (131-145), MN.195 (131-145), MN.202 (131-145) |

TABLE 2-continued

Panel of peptides predicted from protein sequences identified by
transcriptomic anaylsis of Timothy Grass (TG) pollen.

| peptide_sequence (SEQ ID NOS:621-1442) | Prot. ID | SEQ ID | ORF (start-stop) |
|---|---|---|---|
| NTLVAYKSAQDIALA | 86 | 1282 | MN.101 (82-96), MN.156 (140-154), MN.163 (9-23), MN.175 (9-23), MN.181 (152-166), MN.194 (152-166), MN.195 (152-166), MN.202 (152-166), MN.97 (6-20) |
| LPTTHPIRLGLALNF | 86 | 1283 | MN.101 (98-112), MN.156 (156-170), MN.163 (25-39), MN.175 (25-39), MN.181 (158-182), MN.194 (168-182), MN.195 (168-182), MN.202 (168-182), MN.97 (22-36) |
| IRLGLALNFSVFYYE | 86 | 1284 | MN.101 (104-118), MN.156 (162-176), MN.163 (31-45), MN.175 (31-45), MN.181 (174-188), MN.194 (174-188), MN.195 (174-188), MN.202 (174-188), MN.97 (28-42) |
| LNFSVFYYEILNSPD | 86 | 1285 | MN.101 (110-124), MN.156 (168-182), MN.163 (37-53), MN.175 (37-51), MN.181 (180-194), MN.194 (180-194), MN.195 (180-194), MN.202 (180-194), MN.97 (34-48) |
| YKDSTLIMQLLRDNL | 86 | 1286 | MN.156 (207-221), MN.163 (76-90), MN.175 (76-90), MN.181 (219-233), MN.194 (219-233), MN.195 (219-233), MN.202 (219-233), MN.54 (37-51), MN.97 (73-84) |
| IMQLLRDNLTLWTSD | 86 | 1287 | MN.156 (213-227), MN.163 (82-96), MN.175 (82-96), MN.181 (225-239), MN.194 (225-239), MN.195 (225-239), MN.202 (225-239), MN.54 (43-37), MN.97 (79-93) |
| GSRALPFLLQLTKQP | 87 | 1288 | MN.153 (7-21) |
| VKVYVVYYSMYGHVG | 87 | 1289 | MN.153 (50-64), MN.157 (26-40), MN.95 (2-16) |
| GVEVKVWQVPEILSE | 87 | 1290 | MN.118 (2-16), MN.122 (9-23), MN.128 (9-23), MN.153 (79-93), MN.92 (16-30), MN.95 (31-45) |
| ADGILFGFPTRFGMM | 87 | 1291 | MN.114 (30-44), MN.118 (41-55), MN.119 (30-44), MN.122 (48-62), MN.128 (48-62), MN.153 (118-132), MN.157 (94-108), MN.92 (55-69), MN.95 (70-84), MN.99 (14-28) |
| FHQGKYFAGIAKKLK | 87 | 1292 | MN.114 (145-159), MN.118 (156-170), MN.119 (145-159), MN.122 (163-177), MN.128 (163-177), MN.157 (209-223), MN.99 (129-143) |
| DVYPTVCLPMCVCVL | 88 | 1293 | MN.72 (3-15) |
| EPAYFATAESVRDHL | 89 | 1294 | MN.199 (20-34), MN.207 (18-32), MN.224 (20-34) |
| QTYYLSMEYLQGRAL | 89 | 1295 | MN.199 (62-66), MN.207 (50-64), MN.224 (52-68) |
| AVGNLGITGAYAEAV | 89 | 1296 | MN.199 (69-83), MN.207 (67-81), MN.224 (69-83) |
| AEAVKKFGYELEALA | 89 | 1297 | MN.199 (80-94), MN.207 (78-92), MN.224 (80-94) |
| RLAACFLDSMATLNL | 89 | 1298 | MN.199 (109-123), MN.207 (107-121), MN.214 (3-17), MN.218 (0-14), MN.219 (3-17), MN.220 (3-17), MN.221 (4-18), MN.222 (4-18), MN.223 (26-40), MN.224 (109-123) |
| LRYRYGLFKQRIAKE | 89 | 1299 | MN.199 (130-144), MN.207 (128-142), MN.214 (24-38), MN.218 (21-35), MN.219 (24-38), MN.220 (24-38), MN.221 (25-39), MN.222 (25-39), MN.223 (47-61), MN.224 (130-144) |
| FSPWEIVRHDVVYPV | 89 | 1300 | MN.199 (157-171), MN.207 (155-169), MN.214 (51-65), MN.215 (26-40), MN.216 (25-39), MN.217 (26-40), MN.218 (48-62), MN.219 (51-65), MN.220 (51-65), MN.221 (52-66), MN.222 (52-66), MN.223 (74-88), MN.224 (157-171) |
| VYPVRFFGHVEILPD | 89 | 1301 | MN.207 (166-180), MN.214 (62-76), MN.216 (36-50), MN.219 (62-76), MN.220 (62-76), MN.221 (63-77), MN.222 (63-77), MN.223 (85-99) |
| GEVLNALAYDVPIPG | 89 | 1302 | MN.199 (190-204), MN.207 (188-202), MN.214 (84-98), MN.215 (59-73), MN.216 (58-72), MN.217 (59-73), MN.218 (81-95), MN.219 (84-98), MN.220 (84-98), MN.221 (85-99), MN.222 (85-99), MN.223 (107-121), MN.224 (190-204) |
| IPGYKTKNAISLRLW | 89 | 1303 | MN.199 (202-216), MN.207 (200-214), MN.214 (96-110), MN.215 (71-85), MN.216 (70-84), MN.217 (73-85), MN.218 (93-107), MN.219 (96-110), |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| | | | MN.220 (96-110), MN.221 (97-111), MN.222 (97-111), MN.223 (119-133), MN.224 (202-216) |
| AEDFNLFQFNDGQYE | 89 | 1304 | MN.199 (222-236), MN.207 (220-234), MN.214 (116-130), MN.215 (91-105), MN.216 (90-104), MN.217 (91-105), MN.218 (113-127), MN.219 (116-130), MN.220 (116-130), MN.221 (117-131), MN.222 (117-131), MN.223 (139-153), MN.224 (222-236) |
| EGKLLRLKQQFFLCS | 89 | 1305 | MN.199 (260-274), MN.207 (258-272), MN.214 (154-168), MN.215 (129-143), MN.216 (128-142), MN.217 (129-143), MN.218 (151-165), MN.219 (154-168), MN.220 (154-168), MN.221 (155-169), MN.222 (155-169), MN.223 (177-191) MN.224 (260-274) |
| LKQQFFLCSASLQDI | 89 | 1306 | MN.199 (266-280), MN.207 (264-278), MN.214 (160-174), MN.215 (135-149), MN.216 (134-148), MN.217 (135-149), MN.218 (157-171), MN.219 (160-174), MN.220 (160-174), MN.221 (161-175), MN.222 (161-175), MN.223 (183-197), MN.224 (266-280) |
| PTLAIPELMRLLMDE | 89 | 1307 | MN.199 (312-325), MN.207 (310-324), MN.234 (206-220), MN.215 (181-195), MN.216 (180-194), MN.217 (181-195), MN.218 (203-217), MN.219 (206-220), MN.220 (206-220), MN.221 (207-221), MN.222 (207-221), MN.223 (229-243) MN.224 (312-326) |
| QSVMRKLLPRQMEII | 89 | 1308 | MN.199 (359-373), MN.207 (357-371), MN.214 (253-267), MN.215 (228-242), MN.216 (227-241), MN.217 (228-242), MN.218 (250-264), MN.219 (253-267), MN.220 (253-267), MN.221 (254-268), MN.222 (254-268), MN.223 (276-290) MN.224 (359-373) |
| EEIDKRFREMVISTR | 89 | 1309 | MN.207 (372-385), MN.214 (268-282), MN.235 (243-257), MN.216 (242-256), MN.217 (243-257), MN.238 (265-279), MN.219 (268-282), MN.220 (268-282), MN.221 (269-283), MN.222 (269-283), MN.223 (291-305), MN.224 (374-386) |
| PQKPVVRMANLCVVS | 89 | 1310 | MN.207 (403-417), MN.214 (299-313), MN.215 (274-288), MN.216 (273-287), MN.217 (274-288), MN.218 (296-310), MN.219 (299-313), MN.220 (299-313), MN.221 (300-314), MN.222 (300-314), MN.223 (322-336), MN.224 (405-419) |
| ILKEELFADYVSIWP | 89 | 1311 | MN.207 (431-445), MN.214 (327-341), MN.215 (302-316), MN.216 (301-315), MN.217 (302-316), MN.218 (324-338), MN.207 (327-341), MN.220 (327-341), MN.221 (328-342), MN.222 (328-342), MN.223 (350-364), MN.224 (433-447) |
| PRRWLRFCNPELSEI | 89 | 1312 | MN.207 (457-471), MN.214 (353-367), MN.215 (328-342), MN.216 (327-341), MN.217 (328-342), MN.218 (350-364), MN.219 (353-367), MN.220 (353-367), MN.221 (354-368), MN.222 (354-368), MN.223 (376-390), MN.224 (459-473) |
| EKLHAEWAAAKLASK | 89 | 1313 | MN.214 (394-408), MN.215 (369-383), MN.216 (368-382), MN.217 (369-383), MN.218 (391-405), MN.219 (394-408), MN.220 (394-408), MN.221 (385-408), MN.222 (395-409), MN.223 (417-431), MN.224 (500-514) |
| IKRIHEYKRQLMNIL | 89 | 1314 | MN.214 (433-447), MN.215 (408-422), MN.216 (407-421), MN.217 (408-422), MN.218 (430-444), MN.219 (433-447), MN.220 (433-447), MN.221 (434-448), MN.222 (434-448), MN.223 (456-470), MN.224 (539-553) |
| YKRQLMNILGAVYRY | 89 | 1315 | MN.214 (439-453), MN.215 (414-428), MN.216 (413-427), MN.217 (414-428), MN.218 (436-450), MN.219 (439-453), MN.220 (439-453), MN.221 (440-454), MN.222 (440-454), MN.223 (462-476), MN.224 (545-559) |
| LGAVYRYKKLKEMSA | 89 | 1316 | MN.214 (447-461), MN.215 (422-436), MN.216 (421-435), MN.217 (422-436), MN.218 (444-458), MN.219 (447-461), MN.220 (447-461), MN.221 (448-462), MN.222 (448-462), MN.223 (470-484), MN.224 (553-567) |
| GKAFATYTNAKRIVK | 89 | 1317 | MN.214 (476-490), MN.215 (451-465), MN.216 (450-464), MN.217 (451-465), MN.218 (473-487), MN.219 (476-490), MN.220 (476-490), MN.221 (477-491), MN.222 (477-493), MN.223 (499-513), MN.224 (582-596) |
| KRIVKLVNDVGAVVN | 89 | 1318 | MN.214 (486-500), MN.215 (461-475), MN.216 (460-474), MN.217 (461-475), MN.218 (483-497), MN.219 (486-500), MN.220 (486-500), MN.221 (487-501), MN.222 (487-501), MN.223 (509-523), MN.224 (592-606) |
| VNKYLKVVFIPNYNV | 89 | 1319 | MN.214 (505-519), MN.215 (480-494), MN.216 (479-493), MN.217 (480-494), MN.218 (502-516), MN.219 (505-519), MN.220 (505-519), MN.221 (506-520), MN.222 (506-520), MN.223 (528-542), MN.224 (611-625) |

TABLE 2-continued

Panel of peptides predicted from protein sequences identified by transcriptomic anaylsis of Timothy Grass (TG) pollen.

| peptide_sequence (SEQ ID NOS:621-1442) | Prot. ID | SEQ ID | ORF (start-stop) |
|---|---|---|---|
| VFIPNYNVSVAEVLI | 89 | 1320 | MN.214 (512-526), MN.215 (487-501), MN.216 (486-500), MN.217 (487-501), MN.218 (509-523), MN.219 (512-526), MN.220 (512-526), MN.221 (513-527), MN.222 (513-527), MN.223 (535-549), MN.224 (618-632) |
| EDNFFLFGAKADQVA | 89 | 1321 | MN.214 (574-588), MN.215 (549-563), MN.216 (548-562), MN.217 (549-563), MN.218 (571-585), MN.219 (574-588), MN.220 (574-568), MN.221 (575-589), MN.222 (575-589), MN.223 (597-611), MN.224 (680-694) |
| TFGTYDYTPLLDSLE | 89 | 1322 | MN.214 (616-630), MN.215 (591-605), MN.216 (590-604), MN.217 (591-605), MN.218 (613-627), MN.219 (616-630), MN.220 (616-630), MN.221 (617-631), MN.222 (617-631), MN.223 (639-653), MN.224 (722-736) |
| FLVGYDFPSYIDAQA | 89 | 1323 | MN.214 (641-655), MN.216 (615-629), MN.218 (638-652), MN.219 (641-655), MN.220 (641-655), MN.221 (642-656), MN.222 (642-650), MN.223 (664-678), MN.224 (747-761) |
| KRWIKMSILNTAGSG | 89 | 1324 | MN.216 (639-653), MN.218 (662-676), MN.219 (665-679), MN.220 (665-679), MN.221 (666-680), MN.222 (666-680), MN.223 (688-702), MN.224 (771-785) |
| QYAKEIWGITANPVP | 89 | 1325 | MN.216 (663-677), MN.218 (686-700), MN.219 (689-703), MN.220 (689-703), MN.221 (690-704), MN.222 (690-704), MN.223 (712-726), MN.224 (795-809) |
| KTLAVALGGARPLAT | 90 | 1326 | MN.111 (24-38), MN.142 (17-31), MN.158 (25-39), MN.162 (32-46) |
| LATRGVATFTLPDLP | 90 | 1327 | MN.111 (36-50), MN.141 (0-14), MN.142 (29-43), MN.158 (37-51), MN.162 (44-58) |
| PDLPYDYGALEPAIS | 90 | 1328 | MN.111 (47-61), MN.141 (11-25), MN.142 (40-54), MN.158 (48-62), MN.162 (55-69) |
| HATYVANYNKALEQL | 90 | 1329 | MN.111 (73-87), MN.141 (37-51), MN.142 (66-80), MN.158 (74-88), MN.162 (81-95) |
| GDASAVVQLQGAIKF | 90 | 1330 | MN.111 (94-108), MN.141 (58-72), MN.142 (87-101), MN.158 (95-109), MN.162 (102-116) |
| DPLVTKGANLIPLLG | 90 | 1331 | MN.112 (73-87), MN.141 (153-167), MN.142 (182-196), MN.158 (190-204), MN.162 (197-211), MN.53 (24-38) |
| ANLIPLLGIDVWEHA | 90 | 1332 | MN.112 (80-94), MN.141 (160-174), MN.142 (189-203), MN.158 (197-211), MN.162 (204-218), MN.53 (31-45) |
| HAYYLQYKNVRPDYL | 90 | 1333 | MN.112 (93-107), MN.141 (173-187), MN.158 (210-224), MN.162 (217-231), MN.53 (44-58) |
| PDYLTNIWKVVNWKY | 90 | 1334 | MN.112 (104-118), MN.141 (184-198), MN.158 (221-235), MN.162 (228-242), MN.53 (55-69) |
| APSGRIVMELYADVV | 91 | 1335 | MN.121 (15-29), MN.127 (15-29), MN.132 (15-29), MN.139 (15-29), MN.146 (15-29) |
| VMELYADVVPKTAEN | 91 | 1336 | MN.120 (28-42), MN.121 (21-35), MN.127 (21-35), MN.130 (40-54), MN.132 (21-35), MN.139 (21-35), MN.146 (21-35) |
| HYKGSSFHRVIPGFM | 91 | 1337 | MN.120 (61-75), MN.121 (54-68), MN.127 (54-68), MN.130 (73-87), MN.132 (54-68), MN.139 (54-68), MN.146 (54-68) |
| SIYGAKFADENFIKK | 91 | 1338 | MN.120 (91-105), MN.121 (84-98), MN.127 (84-98), MN.130 (103-117), MN.132 (84-98), MN.139 (84-98), MN.146 (84-98) |
| NGSQFFLCTAKTAWL | 91 | 1339 | MN.120 (122-136), MN.121 (115-129), MN.127 (115-129), MN.130 (134-148), MN.132 (115-129), MN.139 (115-129), MN.146 (115-129), MN.64 (27-41), MN.87 (54-68), MN.89 (58-72) |
| SQVHIRRPGGAGRDG | 92 | 1340 | MN.37 (0-14) |
| RPGGAGRDGGQLRIP | 92 | 1341 | MN.37 (6-20) |
| RDGGQLRIPSLLHGG | 92 | 1342 | MN.37 (12-26) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| GHGCAQPAMERRKHI | 92 | 1343 | MN.37 (26-40) |
| RKHIEWNCDVCRHGD | 92 | 1344 | MN.37 (37-51) |
| WTTVMRASCGHHRFR | 93 | 1345 | MN.164 (0-14) |
| RFRDCVISSLADFKL | 93 | 1346 | MN.164 (12-26) |
| ISSLADFKLFPVLQH | 93 | 1347 | MN.164 (18-32) |
| PVLQHIISIAVLAIF | 93 | 1348 | MN.164 (28-42) |
| ISIAVLAIFIGLLMI | 93 | 1349 | MN.164 (34-48) |
| DEKLLSVFREGVVYG | 16 | 1350 | MN.66 (2-16) |
| GPGVYDIHSPRIPSK | 84; 16 | 1351 | (12-26), MN.66 (20-34) |
| EEIADDFALFRGTRP | 16 | 1352 | (35-49) |
| FALFRGTRPPRRPKK | 16 | 1353 | MN.66 (41-55) |
| LCPGFCLADVTPETY | 16 | 1354 | MN.66 (67-81) |
| SCRGRCPCSLRTPAW | 66 | 1355 | ME.3566 (3-17) |
| SLRTPAWGSCSRMAP | 66 | 1356 | ME.3566 (11-25) |
| WGSCSRMAPCNCRCP | 66 | 1357 | ME.3566 (17-31) |
| NCRCPCSTRGARRRL | 66 | 1358 | ME.3566 (27-41) |
| STRGARRRLPGRTSS | 66 | 1359 | ME.3566 (33-47) |
| PWRPPRRWSCCPLPW | 68 | 1360 | ME.3720 (7-21), ME.3805 (7-21) |
| SCCPLPWPGTRRWWF | 68 | 1361 | ME.3720 (15-29), ME.3805 (15-29) |
| GTRRWWFRCHQPPSS | 68 | 1362 | ME.3720 (23-37), ME.3805 (23-37) |
| FRCHQPPSSRTAPGS | 68 | 1363 | ME.3720 (29-43), ME.3805 (29-43) |
| PGSSRSLYGSPSTSC | 68 | 1364 | ME.3720 (41-55), ME.3805 (41-55) |
| KHLIYVTGWSVYTEI | 72 | 1365 | ME.4234 (7-21) |
| TGWSVYTEITLLRDA | 72 | 1366 | ME.4234 (13-27) |
| SEGVRVLMLVWDDRT | 72 | 1367 | ME.4210 (0-14), ME.4234 (48-62) |
| DDSGSIVQDLQISTM | 72 | 1368 | ME.3897 (12-26), ME.4210 (51-65), ME.4234 (99-113) |
| LQISTMFTHKQKIVV | 72 | 1369 | ME.3897 (21-35), ME.4210 (60-74), ME.4234 (108-122) |
| RRRIMSFVGGLDLC | 72 | 1370 | ME.3897 (48-62), ME.4115 (4-18), ME.4210 (87-101), ME.4234 (135-149) |
| PVAWDVLYNFEQRWR | 72 | 1371 | ME.3897 (114-128), ME.4088 (28-42), ME.4115 (70-84), ME.4210 (153-167), ME.4234 (201-215) |
| GKDLLIQLRDLADEI | 72 | 1372 | ME.3897 (132-146), ME.4088 (46-60), ME.4115 (88-102), ME.4210 (171-185), ME.4234 (219-233) |
| AWNVQLFRSIDGGAA | 72 | 1373 | ME.3897 (160-174), ME.4088 (74-88), ME.4115 (116-130), ME.4234 (247-261) |
| DAYICAIRRAKSFIY | 72 | 1374 | ME.3897 (203-217), ME.4088 (117-131), ME.4115 (159-173), ME.4210 (242-256) |
| IRRAKSFIYIENQYF | 72 | 1375 | ME.3897 (209-223), ME.4088 (123-137), ME.4115 (165-179), ME.4210 (248-262), ME.4234 (296-310) |

TABLE 2-continued

Panel of peptides predicted from protein sequences identified by
transcriptomic anaylsis of Timothy Grass (TG),pollen.

| peptide_sequence (SEQ ID NOS:621-1442) | Prot. ID | SEQ ID | ORF (start-stop) |
|---|---|---|---|
| FIYIENQYFLGSSYC | 72 | 1376 | ME.3897 (215-229), ME.4088 (129-143), ME.4115 (171-185), ME.4210 (254-268), ME.4234 (302-316) |
| RFTVYVVVPMWPEGI | 72 | 1377 | ME.3897 (263-277), ME.4088 (177-191), ME.4115 (219-233), ME.4210 (302-316), ME.4234 (350-364) |
| RRTMEMMYTDIAQAI | 72 | 1378 | ME.3897 (291-305), ME.4088 (205-219), ME.4115 (247-261), ME.4210 (330-344), ME.4234 (378-392) |
| MYTDIAQAIQAKGID | 72 | 1379 | ME.3897 (297-311), ME.4088 (211-225), ME.4115 (253-267), ME.4210 (336-350), ME.4234 (384-398) |
| DYLKAQQNRRFMIYV | 72 | 1380 | ME.3897 (345-359), ME.4088 (259-273), ME.4115 (301-315), ME.4210 (384-398), ME.4234 (432-446) |
| FMIYVHTKMMIVDDE | 72 | 1381 | ME.3897 (355-359), ME.4088 (259-283), ME.4115 (311-325), ME.4210 (394-408), ME.4234 (442-445) |
| IVDDEYIIVGSANIN | 72 | 1382 | ME.3897 (365-379), ME.4088 (279-293), ME.4115 (321-335), ME.4210 (404-418), ME.4234 (452-466) |
| YQPYHLAASRPARGQ | 72 | 1383 | ME.4088 (310-324), ME.4115 (352-356), ME.4210 (435-449), ME.4234 (483-497) |
| GQVHGFRMALWYEHL | 72 | 1384 | ME.4088 (323-337), ME.4115 (365-379), ME.4210 (448-462), ME.4234 (496-510) |
| RMALWYEHLGMVDEA | 72 | 1385 | ME.4088 (329-343), ME.4115 (371-385), ME.4210 (454-468), ME.4234 (502-616) |
| CVRKVNAMADRYWNL | 72 | 1386 | ME.4088 (325-366), ME.4115 (394-408), ME.4210 (477-491), ME.4234 (525-539) |
| LPGVEFFPDTQARIL | 72 | 1387 | ME.4088 (396-410), ME.4115 (438-452), ME.4210 (521-535), ME.4234 (569-583) |
| TAPTSRRSPSAPSPH | 67 | 1388 | ME.4056 (6-20), ME.4276 (8-22) |
| TRTCISTRRIPSRPT | 67 | 1389 | ME.4056 (38-52), ME.4276 (40-54) |
| PWSTCRAARSPTPSA | 67 | 1390 | ME.4056 (55-69), ME.4276 (57-71) |
| DRREIWLSEMVAWVG | 67 | 1391 | ME.4056 (93-107), ME.4276 (95-109) |
| SEMVAWVGLQLAFWI | 67 | 1392 | ME.4056 (100-114), ME.4276 (102-116) |
| VKVAPAALVNVLEAR | 69 | 1393 | ME.3916 (0-14) |
| LVNVLEARSALTISV | 69 | 1394 | ME.3916 (7-21) |
| ARSALTISVLRISSM | 69 | 1395 | ME.3916 (13-27) |
| ISVLRISSMPFSVYH | 69 | 1396 | ME.3916 (19-33) |
| LAAFWGKRYPLLSAG | 69 | 3197 | ME.3916 (52-66) |
| SSPSCAPESTHAVRA | 70 | 1398 | ME.3855 (0-14) |
| PESTHAVRALPSTHT | 70 | 1399 | ME.3855 (6-20) |
| VRALPSTHTARILLR | 70 | 1400 | ME.3855 (12-26) |
| THTARILLRSTTANV | 70 | 1401 | ME.3855 (18-32) |
| LLRSTTANVSGCKDR | 70 | 1402 | ME.3855 (24-38) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| VQVPGGHQGDLPRGE | 71 | 1403 | ME.1412 (1-15) |
| LPGAAGEVCRRRRRR | 71 | 1404 | ME.1412 (21-35) |
| GQGQVDRAQGVVGSH | 71 | 1405 | ME.1412 (44-58) |
| GVVGSHLEDRHSRQA | 71 | 1406 | ME.1412 (53-67) |
| LEDRHSRQAHRPLHR | 71 | 1407 | ME.1412 (59-73) |
| HTFKSLFESWPVSST | 73 | 1408 | ME.4280 (41-55), ME.4281 (41-55) |
| DCYIVLYTYHSGEKR | 73 | 1409 | ME.4229 (33-47), ME.4231 (34-48), ME.4280 (126-140), ME.4281 (126-140) |
| FYLTYWIGKDSVLED | 73 | 1410 | ME.4229 (50-64), ME.4231 (51-65), ME.4280 (143-157), ME.4281 (143-157) |
| QHMALQIATTIWNSM | 73 | 1411 | ME.4190 (3-17), ME.4229 (65-79), ME.4231 (66-80), ME.4280 (158-172), ME.4281 (158-172) |
| EPPQFIALFQPMVIL | 73 | 1412 | ME.4229 (93-107), ME.4231 (94-108), ME.4280 (186-200), ME.4281 (186-200) |
| KDETYSGTGIALVHI | 73 | 1413 | ME.4190 (63-77), ME.4229 (125-139), ME.4231 (126-140), ME.4280 (218-232), ME.4281 (218-232) |
| GTGIALVHIHGTSIH | 73 | 1414 | ME.4190 (69-83), ME.4229 (131-145), ME.4231 (132-146), ME.4280 (224-238), ME.4281 (224-238) |
| NNKTLQVDAVSISLS | 73 | 1415 | ME.4190 (84-98), ME.4229 (348-160), ME.4231 (147-181), ME.4280 (239-253), ME.4281 (239-253) |
| TDCFVLQSGNSMFTW | 73 | 1416 | ME.4190 (100-114), ME.4229 (162-176), ME.4231 (163-177), ME.4280 (255-269), ME.4281 (255-269) |
| QQQWAAKVAEFLKPG | 73 | 1417 | ME.4190 (123-137), ME.4229 (185-199), ME.4231 (186-200), ME.4280 (278-292), ME.4281 (278-292) |
| DVLREPHLYTFSFRN | 73 | 1418 | ME.4190 (170-184), ME.4229 (232-246), ME.4231 (233-247), ME.4280 (325-339), ME.4281 (325-339) |
| LEVTEVFNFSQDDLL | 73 | 1419 | ME.4190 (187-201), ME.4229 (249-253), ME.4231 (250-264), ME.4280 (342-386), ME.4281 (342-356) |
| FNFSQDDLLTEDVMI | 73 | 1420 | ME.4190 (193-207), ME.4229 (255-269), ME.4231 (256-270), ME.4280 (348-362), ME.4281 (348-362) |
| DVMILDTHAEVFVWM | 73 | 1421 | ME.4190 (204-218), ME.4229 (266-280), ME.4231 (267-281), ME.4280 (359-373), ME.4281 (359-373) |
| CFFRTYFSWDNTRSV | 73 | 1422 | ME.4190 (263-277), ME.4229 (325-339), ME.4231 (326-340), ME.4280 (418-432), ME.4281 (418-432) |
| NSFQKKLSLLFGMRS | 73 | 1423 | ME.4190 (281-299), ME.4229 (343-357), ME.4231 (344-358), ME.4280 (436-450), ME.4281 (436-450) |
| RASALAALSSAFNPS | 73 | 1424 | ME.4190 (310-324), ME.4229 (372-386), ME.4231 (373-387), ME.4280 (465-479), ME.4281 (465-479) |
| QRASALAALSSSLNP | 73 | 1425 | ME.4190 (344-358), ME.4229 (406-420), ME.4231 (407-421), ME.4280 (499-513), ME.4281 (499-513) |

TABLE 2-continued

Panel of peptides predicted from protein sequences identified by transcriptomic anaylsis of Timothy Grass (TG),pollen.

| peptide_sequence (SEQ ID NOS:621-1442) | Prot. ID | SEQ ID | ORF (start-stop) |
|---|---|---|---|
| SQRAAAVAALSNVLT | 73 | 1426 | ME.4190 (375-389), ME.4229 (437-451), ME.4231 (438-452), ME.4280 (530-544), ME.4281 (530-544) |
| VAALSNVLTAEGSTL | 73 | 1427 | ME.4190 (381-395), ME.4229 (449-457), ME.4231 (444-458), ME.4280 (536-550), ME.4281 (536-550) |
| ETTFSYDRLISKSTD | 73 | 1428 | ME.4190 (445-459), ME.4229 (507-521), ME.4231 (508-522), ME.4280 (600-614), ME.4281 (600-614) |
| YKRRETYLSDSEFET | 73 | 1429 | ME.4190 (466-480), ME.4229 (528-542), ME.4231 (529-543), ME.4280 (621-635), ME.4281 (621-635) |
| SEFETVFGVTKEEFY | 73 | 1430 | ME.4190 (476-490), ME.4231 (539-553), ME.4280 (631-645), ME.4281 (631-645) |
| SRSFLKHSLLRTQRL | 73 | 1431 | ME.4229 (566-880) |
| HSLLRTQRLHKFLVC | 73 | 1432 | ME.4229 (572-586) |
| LHKFLVCSSMIGVMA | 73 | 1433 | ME.4229 (580-594) |
| SGNLVMFQMQDHQLI | 73 | 1434 | ME.4229 (600-614) |
| QLIYPLISPSFLVYS | 73 | 1435 | ME.4229 (612-626) |
| ISPSFLVYSFFVHDL | 73 | 1436 | ME.4229 (618-632) |
| ERLIYQTANSRLCSV | 74 | 1437 | ME.4230 (4-18) |
| ANSRLCSVLPKEEFY | 74 | 1438 | ME.4230 (11-25) |
| VLPKEEFYQQPRWKQ | 74 | 1439 | ME.4230 (18-32) |
| FYQQPRWKQELQKRK | 74; 73 | 1440 | (24-388), ME.4190 (489-503), ME.4230 (24-38), ME.4231 (552-566), ME.4280 (644-658), ME.4281 (644-658) |
| TGAAAMTTTIRSTA | 75 | 1441 | (1-15) |
| TTIRSTATARPRAIV | 75 | 1442 | ME.3882 (9-23) |

TABLE 3

Panel of 25 MHC II molecules for which peptide binding affinities were predicted.

| Locus | Allele |
|---|---|
| HLA DP | DPA1*01-DPB1*0401 |
|  | DPA1*0103-DPB1*0201 |
|  | DPA1*0201-DPB1*0101 |
|  | DPA1*0201-DPB1*0501 |
|  | DPA1*0301-DPB1*0402 |
| HLA DQ | DQA1*0101-DQB1*0501 |
|  | DQA1*0102-DQB1*0602 |
|  | DQA1*0301-DQB1*0302 |
|  | DQA1*0401-DQB1*0402 |
|  | DQA1*0501-DQB1*0201 |
|  | DQA1*0501-DQB1*0301 |
| HLA DR | DRB1*0101 |
|  | DRB1*0301 |
|  | DRB1*0401 |
|  | DRB1*0404 |
|  | DRB1*0405 |
|  | DRB1*0701 |
|  | DRB1*0802 |
|  | DRB1*0901 |
|  | DRB1*1101 |
|  | DRB1*1302 |
|  | DRB1*1501 |
|  | DRB3*0101 |
|  | DRB4*0101 |
|  | DRB5*0101 |

TABLE 4

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| 1 | $1_{12}$ | E+G+ | 621 | SDGTFARAAVPSGAS | 0 | — | 0 | — |
|  | $1_{18}$ | E+G+ | 622 | RAAVPSGASTGVYEA | 0 | — | 0 | — |
|  | $1_{24}$ | E+G+ | 623 | GASTGVYEALELRDG | 0 | — | 0 | — |
|  | $1_{43}$ | E+G+ | 624 | LGKGVLKGNRANVEL | 0 | — | 0 | — |
|  | $1_{51}$ | E+G+ | 625 | NRANVELFHIAVLLA | 0 | — | 0 | — |
|  | $1_{70}$ | E+G+ | 626 | QTELDNFMVHQLDGT | 0 | — | 0 | — |
|  | $1_{91}$ | E+G+ | 627 | CKQKVFFNISADADA | 0 | — | 0 | — |
|  | $1_{15}$ | E+G+ | 628 | PAMAATIQSVKARQI | 0 | — | 0 | — |
|  | $1_{84}$ | E+G+ | 629 | VDNVNSIIGPALIGK | 0 | — | 0 | — |
|  | $1_{127}$ | E+G+ | 630 | KLGANAILAVSLAVC | 0 | — | 0 | — |
|  | $1_{148}$ | E+G+ | 631 | KKIPLYQHIANLAGN | 0 | — | 0 | — |
|  | $1_{161}$ | E+G+ | 632 | GNKQLVLPVPAFNVI | 0 | — | 1 | 190 |
|  | $1_{184}$ | E+G+ | 633 | KLAMQEFMILPTGAS | 0 | — | 0 | — |
|  | $1_{205}$ | E+G+ | 634 | KMGVEVYHNLKSVIK | 0 | — | 0 | — |
|  | $1_{260}$ | E+G+ | 635 | GKVVIGMDVAASEFY | 0 | — | 0 | — |
|  | $1_{304}$ | E+G+ | 636 | VYKSFVSEYPIVSIE | 1 | 40 | 0 | — |
|  | $1_{342}$ | E+G+ | 637 | IVGDDLLVTNPTRVA | 0 | 0 | 1 | 193 |
|  | $1_{365}$ | E+G+ | 638 | NALLLKVNQIGSVTE | 1 | 40 | 1 | 170 |
|  | $1_{402}$ | E+G+ | 639 | ETEDTFIADLAVGLS | 0 | — | 0 | — |
|  | $1_{429}$ | E+G+ | 640 | ERLAKYNQLLRIEEE | 0 | — | 0 | — |
|  | $1_{444}$ | E+G+ | 641 | LGAAAVYAGLKFRAP | 0 | — | 1 | 153 |
| 2 | $2_{1}$ | E+G+ | 696 | AEFEGVFLDFARQQA | 2 | 58 | 0 | — |
|  | $2_{20}$ | E+G+ | 697 | VDKLFKLAEAAKLKE | 2 | 88 | 2 | 247 |
|  | $2_{49}$ | E+G+ | 698 | ENRSVLHVALRAPRD | 2 | 63 | 1 | 27 |
|  | $2_{116}$ | E+G+ | 699 | FLGPLFVHTALQTDP | 1 | 63 | 0 | — |
|  | $2_{139}$ | E+G+ | 700 | RQLRFLANVDPVDVA | 1 | 20 | 1 | 20 |
|  | $2_{168}$ | E+G+ | 701 | VVSKTFTTAETMLNA | 0 | — | 1 | 97 |
|  | $2_{185}$ | E+G+ | 702 | IKEWIVSSLGPQAVS | 0 | — | 0 | — |
|  | $2_{198}$ | E+G+ | 703 | VSKHMIAVSTNLKLV | 2 | 80 | 1 | 20 |
|  | $2_{232}$ | E+G+ | 704 | RYSVCSAVGVLPLSL | 3 | 83 | 3 | 238 |
|  | $2_{238}$ | E+G+ | 705 | AVGVLPLSLQYGFPI | 3 | 71 | 4 | 121 |
|  | $2_{244}$ | E+G+ | 706 | LSLQYGFPIVQRFLE | 1 | 127 | 1 | 50 |
|  | $2_{250}$ | E+G+ | 707 | FPIVQRFLEGASSID | 2 | 92 | 1 | 90 |
|  | $2_{266}$ | E+G+ | 708 | HFRTASFEKNIPVLL | 1 | 33 | 0 | — |
|  | $2_{278}$ | E+G+ | 709 | VLLGLLSVWNVSFLG | 2 | 50 | 0 | — |
|  | $2_{284}$ | E+G+ | 710 | SVWNVSFLGYPARAI | 1 | 100 | 1 | 53 |
|  | $2_{295}$ | E+G+ | 711 | ARAILPYSQALEKLA | 1 | 120 | 1 | 27 |
|  | $2_{346}$ | E+G+ | 712 | NGQHSFYQLIHQGRV | 1 | 27 | 2 | 95 |
|  | $2_{363}$ | E+G+ | 713 | CDFIGVIKSQQPVYL | 2 | 98 | 2 | 238 |
|  | $2_{387}$ | E+G+ | 714 | ELMSNFFAQPDALAY | 2 | 102 | 3 | 99 |
|  | $2_{421}$ | E+G+ | 715 | KTFKGNRPSLSFLLS | 2 | 42 | 5 | 363 |
|  | $2_{428}$ | E+G+ | 716 | PSLSFLLSSLSAYEI | 1 | 67 | 1 | 53 |
|  | $2_{439}$ | E+G+ | 717 | AYEIGQLLAIYEHRI | 1 | 40 | 0 | — |
|  | $2_{445}$ | E+G+ | 718 | LLAIYEHRIAVQGFI | 1 | 77 | 2 | 42 |
|  | $2_{456}$ | E+G+ | 719 | QGFIWGINSFDQWGV | 1 | 113 | 0 | — |
|  | $2_{493}$ | E+G+ | 720 | PVEGFNPSSASLLAR | 1 | 143 | 1 | 47 |
|  | $2_{499}$ | E+G+ | 721 | PSSASLLARYLAVEP | 1 | 127 | 0 | — |
| 3 | $3_{6}$ | E+G+ | 732 | ILLVFAETAEPEVKV | 0 | — | 0 | — |
|  | $3_{15}$ | E+G+ | 733 | EPEVKVVDLTILSPD | 0 | — | 0 | — |
|  | $3_{50}$ | E+G+ | 734 | LKDGSTYSFRFSFIV | 1 | 20 | 0 | — |
|  | $3_{57}$ | E+G+ | 735 | SFRFSFIVSNNIVSG | 0 | — | 0 | — |
|  | $3_{130}$ | E+G+ | 736 | DDGKVYLEMSYYFEI | 0 | — | 0 | — |
| 4 | $4_{6}$ | E+G+ | 777 | MKTIFDFESIKKLLA | 0 | — | 1 | 43 |
|  | $4_{12}$ | E+G+ | 778 | FESIKKLLASPKFSF | 1 | 47 | 2 | 245 |
|  | $4_{41}$ | E+G+ | 779 | RMFVDELGASESSLL | 1 | 47 | 1 | 30 |
|  | $4_{70}$ | E+G+ | 780 | PNLTYAKELVERMGL | 0 | — | 1 | 33 |
|  | $4_{106}$ | E+G+ | 781 | RNMVLGKRFFVTPSD | 1 | 33 | 1 | 27 |
|  | $4_{112}$ | E+G+ | 782 | KRFFVTPSDSVAIIA | 0 | — | 0 | — |
|  | $4_{119}$ | E+G+ | 783 | SDSVAIIAANAVQSI | 0 | — | 0 | — |
|  | $4_{129}$ | E+G+ | 784 | AVQSIPYFASGLKGV | 0 | — | 1 | 37 |
|  | $4_{158}$ | E+G+ | 785 | KNLNLKFFEVPTGWK | 0 | — | 0 | — |
|  | $4_{203}$ | E+G+ | 786 | GIWAVLAWLSIIAYK | 0 | — | 1 | 107 |
|  | $4_{221}$ | E+G+ | 787 | NLGGDKLVSVEDIVL | 0 | — | 0 | — |
|  | $4_{227}$ | E+G+ | 788 | LVSVEDIVLQHWATY | 0 | — | 0 | — |
|  | $4_{260}$ | E+G+ | 789 | KELMANLVKMQSALS | 1 | 327 | 1 | 97 |
|  | $4_{266}$ | E+G+ | 790 | LVKMQSALSDVNKLI | 2 | 35 | 0 | — |
|  | $4_{309}$ | E+G+ | 791 | HQGIRYLFGDGSRLV | 0 | — | 0 | — |
|  | $4_{320}$ | E+G+ | 792 | SRLVFRLSGTGSVGA | 0 | — | 0 | — |

TABLE 4-continued

Panel of 822 peptides predicted from 93 novel Timothy Grass (TG)
proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $4_{333}$ | E+G+ | 793 | GATIRIYIEQYEKDS | 0 | — | 0 | — |
| | $4_{356}$ | E+G+ | 794 | DALSPLVDVALKLSK | 0 | — | 0 | — |
| 5 | $5_{27}$ | E+G+ | 813 | TVSDEYLAAVAKARR | 0 | — | 1 | 73 |
| | $5_{94}$ | E+G+ | 814 | LDIAVRLLEPIKEQV | 0 | — | 0 | — |
| | $5_{104}$ | E+G+ | 815 | IKEQVPILSYADFYQ | 0 | — | 0 | — |
| | $5_{110}$ | E+G+ | 816 | ILSYADFYQLAGVVA | 0 | — | 0 | — |
| | $5_{116}$ | E+G+ | 817 | FYQLAGVVAVEITGG | 0 | — | 0 | — |
| | $5_{159}$ | E+G+ | 818 | DHLRQVFTAQMGLSD | 0 | — | 0 | — |
| | $5_{202}$ | E+G+ | 819 | NPLIFDNSYFTELLT | 0 | — | 0 | — |
| | $5_{248}$ | E+G+ | 820 | EDAFFADYAEAHLKL | 0 | — | 0 | — |
| 6 | $6_{1}$ | E+G+ | 827 | TLLFPHTQISLPSVR | 2 | 32 | 0 | — |
| | $6_{14}$ | E+G+ | 828 | VRTRKHLAATMADEK | 0 | — | 0 | — |
| | $6_{44}$ | E+G+ | 829 | DNEKSGFISLVSRYL | 2 | 38 | 0 | — |
| | $6_{50}$ | E+G+ | 830 | FISLVSRYLSGEEEH | 0 | — | 0 | — |
| | $6_{92}$ | E+G+ | 831 | EATKALLNKLAVLKL | 1 | 33 | 0 | — |
| | $6_{123}$ | E+G+ | 832 | IEVRNGFTFLDLIVL | 1 | 27 | 0 | — |
| | $6_{131}$ | E+G+ | 833 | FLDLIVLQIESLNKK | 1 | 33 | 0 | — |
| | $6_{142}$ | E+G+ | 834 | LNKKYGSNVPLLLMN | 1 | 353 | 0 | — |
| | $6_{149}$ | E+G+ | 835 | NVPLLLMNSFNTHED | 1 | 153 | 0 | — |
| | $6_{165}$ | E+G+ | 836 | LKIVEKYANSSIDIH | 3 | 196 | 3 | 654 |
| | $6_{175}$ | E+G+ | 837 | SIDIHTFNQSQYPRV | 2 | 113 | 1 | 243 |
| | $6_{224}$ | E+G+ | 838 | GKLDLLLSQGKEYVF | 1 | 87 | 2 | 65 |
| | $6_{233}$ | E+G+ | 839 | GKEYVFIANSDNLGA | 2 | 115 | 0 | — |
| | $6_{242}$ | E+G+ | 840 | SDNLGAIVDMKILNH | 2 | 28 | 1 | 30 |
| | $6_{248}$ | E+G+ | 841 | IVDMKILNHLIHKQN | 3 | 101 | 2 | 160 |
| | $6_{282}$ | E+G+ | 842 | ISYEGRVQLLEIAQV | 0 | — | 0 | — |
| | $6_{288}$ | E+G+ | 843 | VQLLEIAQVPDAHVD | 1 | 73 | 0 | — |
| | $6_{304}$ | E+G+ | 844 | FKSIEKFKIFNTNNL | 1 | 30 | 1 | 357 |
| | $6_{310}$ | E+G+ | 845 | FKIFNTNNLWVNLKA | 2 | 60 | 0 | — |
| | $6_{316}$ | E+G+ | 846 | NNLWVNLKAIKRLVE | 3 | 517 | 2 | 823 |
| | $6_{325}$ | E+G+ | 847 | IKRLVEADALKMEII | 2 | 103 | 1 | 397 |
| | $6_{348}$ | E+G+ | 848 | VKVLQLETAAGAAIR | 3 | 60 | 1 | 50 |
| | $6_{359}$ | E+G+ | 849 | AAIRFFDHAIGINVP | 4 | 105 | 4 | 344 |
| | $6_{369}$ | E+G+ | 850 | GINVPRSRFLPVKAT | 1 | 23 | 0 | — |
| | $6_{376}$ | E+G+ | 851 | RFLPVKATSDLQLVQ | 2 | 60 | 1 | 83 |
| | $6_{383}$ | E+G+ | 852 | TSDLQLVQSDLYTLV | 1 | 40 | 1 | 87 |
| | $6_{389}$ | E+G+ | 853 | VQSDLYTLVDGFVTR | 2 | 82 | 1 | 60 |
| | $6_{418}$ | E+G+ | 854 | GPEFKKVGSFLGRFK | 2 | 182 | 2 | 147 |
| | $6_{429}$ | E+G+ | 855 | GRFKSIPSIVELDSL | 3 | 247 | 0 | — |
| 7 | $7_{31}$ | E+G+ | 860 | GTIRNIINGTVFREP | 3 | 109 | 2 | 523 |
| | $7_{101}$ | E+G+ | 861 | VFNFTGAGGVALAMY | 3 | 118 | 3 | 968 |
| | $7_{121}$ | E+G+ | 862 | IQGFAEASMAIAYEK | 2 | 33 | 1 | 50 |
| | $7_{127}$ | E+G+ | 863 | ASMAIAYEKKWPLYL | 2 | 52 | 1 | 80 |
| | $7_{134}$ | E+G+ | 864 | EKKWPLYLSTKNTIL | 1 | 63 | 1 | 117 |
| | $7_{153}$ | E+G+ | 865 | GRFKDIFQAVYEADW | 1 | 57 | 2 | 63 |
| | $7_{177}$ | E+G+ | 866 | WYEHRLIDDMVAYAL | 1 | 43 | 0 | — |
| | $7_{208}$ | E+G+ | 867 | VQSDFLAQGFGSLGL | 2 | 35 | 1 | 80 |
| | $7_{260}$ | E+G+ | 868 | NSIASIFAWTRGLAH | 0 | — | 1 | 63 |
| | $7_{280}$ | IgE+G+ | 869 | DNARLLDFTQKLEDA | 2 | 37 | 0 | — |
| | $7_{304}$ | E+G+ | 870 | MTKDLALLVHGSSKV | 1 | 40 | 2 | 128 |
| | $7_{324}$ | E+G+ | 871 | LNTEEFIDAVAAELQ | 3 | 60 | 3 | 92 |
| 8 | $8_{1}$ | E+G+ | 667 | ALTHTTIVASGIENM | 0 | — | 0 | — |
| | $8_{3}$ | E+G+ | 1115 | TIVASGIENMKIFTR | 0 | — | 1 | 293 |
| | $8_{15}$ | E+G+ | 668 | MKIFTRTWVLLLLVV | 0 | — | 0 | — |
| | $8_{24}$ | E+G+ | 669 | LLLLVVLLFEGCLAK | 0 | — | 0 | — |
| | $8_{110}$ | E+G+ | 670 | KDTHYTLSAWLQLSK | 0 | — | 0 | — |
| | $8_{166}$ | E+G+ | 671 | GKGELFFETNVTAEL | 0 | — | 0 | — |
| | $8_{176}$ | E+G+ | 672 | VTAELMVDSMSLQPF | 0 | — | 0 | — |
| | $8_{253}$ | E+G+ | 673 | YEKWFTSRFTVATME | 0 | — | 0 | — |
| | $8_{313}$ | E+G+ | 674 | KQMDWVSKLSAPQLK | 0 | — | 0 | — |
| | $8_{382}$ | E+G+ | 675 | KPILFMNEYNTIEEP | 0 | — | 0 | — |
| | $8_{404}$ | E+G+ | 676 | TKYLAKLKQIQSYPG | 0 | — | 0 | — |
| | $8_{438}$ | E+G+ | 677 | PYVRGSLDTLAQAKV | 0 | — | 0 | — |
| | $8_{465}$ | E+G+ | 678 | PKQVEYLEEVMREGF | 0 | — | 0 | — |
| | $8_{172}$ | E+G+ | 679 | NVTAELVDSMSLQPF | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 | | Total response IFNg | |
|---|---|---|---|---|---|---|---|---|
| | | | | | Events | SFC | Events | SFC |
| 9 | $9_{56}$ | E+G+ | 892 | TDTIVYCAGRTFFFR | 0 | — | 1 | 180 |
| | $9_{64}$ | E+G+ | 893 | GRTFFFRRLDAPLDA | 0 | — | 1 | 383 |
| | $9_{152}$ | E+G+ | 894 | KSLVRAFMWDSGSTV | 0 | — | 0 | — |
| | $9_{175}$ | E+G+ | 895 | RVLSCDFKPTRPFRI | 0 | — | 1 | 97 |
| | $9_{260}$ | E+G+ | 896 | HTGSIYAVSWSADSK | 0 | — | 0 | — |
| | $9_{349}$ | E+G+ | 897 | AGHLKTVSSLTYFPQ | 0 | — | 0 | — |
| | $9_{355}$ | E+G+ | 898 | VSSLTYFPQSNPRTM | 1 | 23 | 0 | — |
| | $9_{373}$ | E+G+ | 899 | SYDGVIIRWIQGVGY | 0 | — | 0 | — |
| | $9_{397}$ | E+G+ | 900 | TQIKCFVAAEEELIT | 1 | 20 | 0 | — |
| | $9_{441}$ | E+G+ | 901 | NALNIAVQQPEFALI | 1 | 60 | 0 | — |
| | $9_{450}$ | E+G+ | 902 | PEFALITTDSAIVLL | 1 | 33 | 0 | — |
| | $9_{457}$ | E+G+ | 903 | TDSAIVLLHKSTVTS | 0 | — | 0 | — |
| | $9_{473}$ | E+G+ | 904 | TKVSYTITSSAVSPD | 0 | — | 0 | — |
| | $9_{499}$ | E+G+ | 905 | KLRIYSISGDTLTEE | 0 | — | 1 | 53 |
| | $9_{526}$ | E+G+ | 906 | IHYSPDVSMFASADA | 1 | 30 | 0 | — |
| | $9_{554}$ | E+G+ | 907 | IKLKNMLFHTARINC | 1 | 33 | 1 | 20 |
| 10 | $10_{10}$ | E+G+ | 974 | GRYFSKDAVQIITKM | 1 | 43 | 1 | 170 |
| | $10_{16}$ | E+G+ | 975 | DAVQIITKMAAANGV | 1 | 160 | 1 | 83 |
| | $10_{29}$ | E+G+ | 976 | GVRRVWVGQDSLLST | 0 | — | 2 | 30 |
| | $10_{39}$ | E+G+ | 977 | SLLSTPAVSAIIRER | 1 | 37 | 2 | 30 |
| | $10_{45}$ | E+G+ | 978 | AVSAIIRERIAADGS | 1 | 60 | 1 | 47 |
| 11 | $11_{58}$ | E+G+ | 992 | SVGFVETLENDLAQL | 1 | 30 | 1 | 47 |
| | $11_{111}$ | E+G+ | 993 | LGEAPYKFKSALEAV | 1 | 53 | 2 | 488 |
| | $11_{117}$ | E+G+ | 994 | KFKSALEAVKTLRAE | 1 | 43 | 1 | 73 |
| | $11_{137}$ | E+G+ | 995 | QYLPAFVIVDESGKS | 1 | 23 | 0 | — |
| | $11_{161}$ | E+G+ | 996 | VVTFNFRADRMVMLA | 2 | 50 | 0 | — |
| | $11_{168}$ | E+G+ | 997 | ADRMVMLAKALEFAD | 1 | 40 | 0 | — |
| | $11_{183}$ | E+G+ | 998 | FDKFDRVRVPKIKYA | 0 | — | 0 | — |
| | $11_{192}$ | E+G+ | 999 | PKIKYAGMLQYDGEL | 0 | — | 0 | — |
| | $11_{206}$ | E+G+ | 1000 | LKLPNKFLVSPPLIE | 1 | 30 | 0 | — |
| 12 | $12_{5}$ | E+G+ | 1013 | YKLLCSSFPVITYHQ | 2 | 60 | 0 | — |
| | $12_{12}$ | E+G+ | 1014 | FPVITYHQGRNGNLS | 1 | 103 | 0 | — |
| | $12_{21}$ | E+G+ | 1015 | RNGNLSALACPLNQK | 1 | 20 | 0 | — |
| 13 | $13_{21}$ | E+G+ | 1021 | ECILSGLLSVDGLKV | 0 | — | 0 | — |
| | $13_{27}$ | E+G+ | 1022 | LLSVDGLKVLHMDRN | 0 | — | 0 | — |
| | $13_{81}$ | E+G+ | 1023 | VPKFMMANGALVRVL | 0 | — | 0 | — |
| | $13_{92}$ | E+G+ | 1024 | VRVLIRTSVTKYLNF | 0 | — | 0 | — |
| | $13_{101}$ | E+G+ | 1025 | TKYLNFKAVDGSFVY | 0 | — | 0 | — |
| | $13_{126}$ | E+G+ | 1026 | TDVEALKSNLMGLFE | 0 | — | 0 | — |
| | $13_{140}$ | E+G+ | 1027 | EKRRARKFFIYVQDY | 0 | — | 0 | — |
| | $13_{146}$ | E+G+ | 1028 | KFFIYVQDYEEEDPK | 0 | — | 0 | — |
| | $13_{185}$ | E+G+ | 1029 | TVDFIGHALALHRDD | 0 | — | 0 | — |
| | $13_{210}$ | E+G+ | 1030 | VKRMKLYAESLARFQ | 0 | — | 0 | — |
| | $13_{237}$ | E+G+ | 1031 | GELPQAFARLSAVYG | 0 | — | 0 | — |
| | $13_{243}$ | E+G+ | 1032 | FARLSAVYGGTYMLN | 0 | — | 0 | — |
| | $13_{352}$ | E+G+ | 1033 | KGKFIAFVSTEAETD | 0 | — | 0 | — |
| | $13_{417}$ | E+G+ | 1034 | ETTVKDVLALYSKIT | 0 | — | 0 | — |
| | $13_{435}$ | E+G+ | 1035 | LDLSVDLNAASAGES | 0 | — | 0 | — |
| 14 | $14_{1}$ | E+G+ | 1087 | LLGYLLWVVAIRRPR | 1 | 110 | 0 | — |
| | $14_{7}$ | E+G+ | 1088 | WVVAIRRPRPVRCFS | 0 | — | 0 | — |
| 15 | $15_{1}$ | E+G+ | 1113 | PRVNFFKRYNLTCVF | 0 | — | 0 | — |
| | $15_{7}$ | E+G+ | 1114 | KRYNLTCVFWSKKKK | 0 | — | 0 | — |
| 16 | $16_{3}$ | E-G- | 1350 | DEKLLSVFREGVVYG | 0 | — | 1 | 113 |
| | $16_{21}$ | E-G- | 1351 | GPGVYDIHSPRIPSK | 0 | — | 2 | 80 |
| | $16_{36}$ | E-G- | 1352 | EEIADDFALFRGTRP | 0 | — | 2 | 207 |
| | $16_{42}$ | E-G- | 1353 | FALFRGTRPPRRPKK | 0 | — | 1 | 97 |
| | $16_{68}$ | E-G- | 1354 | LCPGFCLADVTPETY | 0 | — | 2 | 45 |
| 17 | $17_{2}$ | E+G+ | 1170 | VCTRLSPFCCLYCIL | 2 | 52 | 0 | — |
| | $17_{13}$ | E+G+ | 1171 | YCILCCWYSMRLVTV | 1 | 63 | 0 | — |
| 18 | $18_{1}$ | E+G- | 680 | NIPATWGAMEKLYDA | 0 | — | 0 | — |
| | $18_{7}$ | E+G- | 681 | GAMEKLYDAGKARAI | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 | | Total response IFNg | |
|---|---|---|---|---|---|---|---|---|
| | | | | | Events | SFC | Events | SFC |
| | $18_{17}$ | E+G− | 682 | KARAIGVSNLASKKL | 0 | — | 0 | — |
| | $18_{23}$ | E+G− | 683 | VSNLASKKLGDLLAV | 0 | — | 0 | — |
| | $18_{29}$ | E+G− | 684 | KKLGDLLAVARIPPA | 0 | — | 0 | — |
| 19 | $19_{26}$ | E+G− | 750 | LNGPFIATVQQRGAA | 0 | — | 0 | — |
| | $19_{35}$ | E+G− | 751 | QQRGAAIIKARKLSS | 0 | — | 0 | — |
| | $19_{41}$ | E+G− | 752 | IIKARKLSSALSAAS | 0 | — | 0 | — |
| | $19_{47}$ | E+G− | 753 | LSSALSAASSACDHI | 0 | — | 0 | — |
| | $19_{67}$ | E+G− | 754 | GTPEGTFVSMGVYSD | 0 | — | 0 | — |
| 20 | $20_{25}$ | E+G− | 800 | PPPGQHIAMAASSRR | 0 | — | 0 | — |
| | $20_{40}$ | E+G− | 801 | ASQLLGSAASRFLHS | 0 | — | 0 | — |
| | $20_{49}$ | E+G− | 802 | SRFLHSRGYAAAAAA | 0 | — | 0 | — |
| | $20_{55}$ | E+G− | 803 | RGYAAAAAAPSPAVF | 0 | — | 0 | — |
| | $20_{114}$ | E+G− | 804 | LGLPVFNSVAEAKAE | 0 | — | 0 | — |
| | $20_{129}$ | E+G− | 805 | TKANASVIYVPPPFA | 0 | — | 0 | — |
| | $20_{135}$ | E+G− | 806 | VIYVPPPFAAAAIME | 0 | — | 0 | — |
| | $20_{141}$ | E+G− | 807 | PFAAAAIMEALEAEL | 0 | — | 0 | — |
| | $20_{167}$ | E+G− | 808 | QHDMVKVKAALNRQS | 0 | — | 0 | — |
| | $20_{222}$ | E+G− | 809 | TLTYEAVFQTTAVGL | 0 | — | 0 | — |
| | $20_{294}$ | E+G− | 810 | DKPVVAFIAGLTAPP | 1 | 23 | 0 | — |
| | $20_{329}$ | E+G− | 811 | KIKALREAGVTVVES | 1 | 23 | 0 | — |
| | $20_{348}$ | E+G− | 812 | GSTMFEIFKQRGMVE | 0 | — | 0 | — |
| 21 | $21_{2}$ | E+G− | 659 | GSGDFKTIKEALAKV | 0 | — | 0 | — |
| | $21_{23}$ | E+G− | 660 | MYVMYIKEGTYKEYV | 0 | — | 0 | — |
| | $21_{33}$ | E+G− | 661 | YKEYVTVPRTVTNLV | 0 | — | 0 | — |
| | $21_{43}$ | E+G− | 662 | VTNLVMIGDGAAKTI | 0 | — | 0 | — |
| | $21_{63}$ | E+G− | 663 | NFKMNLTSMVAVSLV | 0 | — | 0 | — |
| | $21_{109}$ | E+G− | 664 | YQDTLYTHAQRQFFR | 0 | — | 0 | — |
| | $21_{129}$ | E+G− | 665 | GTIDPIFGNSQVVIQ | 0 | — | 0 | — |
| | $21_{53}$ | E+G− | 666 | AKTIILKFLLPVMIV | 0 | — | 0 | — |
| 22 | $22_{15}$ | E+G− | 872 | NTRVLLLRRTSPFSA | 1 | — | 0 | — |
| | $22_{124}$ | E+G− | 873 | DGYYIHGQCAIIMFD | 1 | — | 0 | — |
| | $22_{131}$ | E+G− | 874 | QCAIIMFDVTSRLTY | 1 | 27 | 0 | — |
| | $22_{187}$ | E+G− | 875 | RKKNLQYYEISAKSN | 0 | — | 0 | — |
| | $22_{197}$ | E+G− | 876 | SAKSNYNFEKPFLYL | 0 | — | 0 | — |
| | $22_{206}$ | E+G− | 877 | KPFLYLARKLAGDAN | 2 | 88 | 1 | 603 |
| | $22_{219}$ | E+G− | 878 | ANIHFVEAVALKPPE | 0 | — | 1 | 63 |
| | $22_{245}$ | E+G− | 879 | EAELAAAAAQPLPDD | 1 | 20 | 0 | — |
| 23 | $23_{1}$ | E+G− | 936 | RTSSWGSGASLKIDR | 1 | 27 | 0 | — |
| | $23_{10}$ | E+G− | 937 | SLKIDRRELVTTRIY | 2 | 35 | 0 | — |
| 24 | $24_{21}$ | E+G− | 938 | RFLHAAVAMATKRSV | 0 | — | 1 | 150 |
| | $24_{44}$ | E+G− | 939 | KGKKVFLRADLNVPL | 1 | 30 | 3 | 234 |
| | $24_{68}$ | E+G− | 940 | TRIRASIPTIKFLLE | 0 | — | 0 | — |
| | $24_{76}$ | E+G− | 941 | TIKFLLEKGAKVILA | 2 | 47 | 0 | — |
| | $24_{82}$ | E+G− | 942 | EKGAKVILASHLGRP | 1 | 63 | 0 | — |
| | $24_{109}$ | E+G− | 943 | VPRLSELLGVEVVMA | 2 | 70 | 2 | 118 |
| | $24_{141}$ | E+G− | 944 | GGVLLLENVRFYKEE | 2 | 45 | 1 | 23 |
| | $24_{160}$ | E+G− | 945 | PEFAKKLASVADLYV | 2 | 45 | 0 | — |
| | $24_{193}$ | E+G− | 946 | KFLRPSVAGFLMQKE | 3 | 38 | 1 | 177 |
| | $24_{199}$ | E+G− | 947 | VAGFLMQKELDYLVG | 1 | 90 | 0 | — |
| | $24_{206}$ | E+G− | 948 | KELDYLVGAVANPKK | 1 | 37 | 1 | 143 |
| | $24_{234}$ | E+G− | 949 | KIGVIESLLAKVDIL | 1 | 57 | 0 | — |
| | $24_{253}$ | E+G− | 950 | GMIFTFYKAQGKAVG | 0 | — | 2 | 397 |
| | $24_{272}$ | E+G− | 951 | EEDKLELATSLIETA | 2 | 52 | 1 | 23 |
| | $24_{290}$ | E+G− | 952 | GVSLLLPTDVVVADK | 1 | 90 | 0 | — |
| 25 | $25_{2}$ | E+G− | 953 | SAPALRILRSFPSHS | 1 | 97 | 1 | 143 |
| 26 | $26_{2}$ | E+G− | 954 | VELVAVNDPFITTDY | 0 | — | 0 | — |
| | $26_{15}$ | E+G− | 955 | DYMTYMFKYDTVHGQ | 0 | — | 0 | — |
| | $26_{90}$ | E+G− | 956 | GGAKKVIISAPSKDA | 0 | — | 0 | — |
| | $26_{116}$ | E+G− | 957 | YTSDITIVSNASCTT | 0 | — | 0 | — |
| | $26_{138}$ | E+G− | 958 | KVINDRFGIVEGLMT | 0 | — | 1 | 37 |
| | $26_{144}$ | E+G− | 959 | FGIVEGLMTTVHAMT | 0 | — | 0 | — |
| | $26_{174}$ | E+G− | 960 | GGRAASFNIIPSSTG | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $26_{221}$ | E+G− | 961 | LTVRLEKAATYEQIK | 0 | — | 0 | — |
| | $26_{278}$ | E+G− | 962 | ALNDNFVKLVSWYDN | 0 | — | 0 | — |
| 27 | $27_{46}$ | E+G− | 984 | IGKRFASINVENVED | 0 | — | 0 | — |
| | $27_{64}$ | E+G− | 985 | ALRELLFTTPGALQH | 0 | — | 0 | — |
| | $27_{76}$ | E+G− | 986 | LQHISGVILFEETLY | 1 | 53 | 0 | — |
| | $27_{144}$ | E+G− | 987 | YEAGARFAKWRAVLK | 1 | 33 | 0 | — |
| | $27_{175}$ | E+G− | 988 | GLARYAIICQENGLV | 2 | 33 | 1 | 140 |
| | $27_{206}$ | E+G− | 989 | RCAYVTEVVLAACYK | 1 | 27 | 0 | — |
| | $27_{223}$ | E+G− | 990 | NDQHVLLEGSLLKPN | 1 | 27 | 0 | — |
| | $27_{300}$ | E+G− | 991 | WFLSFSFGRALQQST | 1 | 23 | 0 | — |
| 28 | $28_{2}$ | E+G− | 1016 | IPPAPHLKRWNRVVD | 1 | 127 | 0 | — |
| | $28_{8}$ | E+G− | 1017 | LKRWNRVVDTNLESP | 0 | — | 0 | — |
| | $28_{14}$ | E+G− | 1018 | VVDTNLESPNDIVPE | 0 | — | 0 | — |
| | $28_{28}$ | E+G− | 1019 | GAPFTGSGYRIAPYS | 1 | 107 | 0 | — |
| | $28_{36}$ | E+G− | 1020 | GYRIAPYSSILLKAT | 1 | — | 2 | 477 |
| 29 | $29_{2}$ | E+G− | 1072 | SFRFFLAHSSIHPST | 2 | 83 | 0 | — |
| | $29_{26}$ | E+G− | 1073 | EKHFKYVILGGGVAA | 0 | — | 0 | — |
| | $29_{106}$ | E+G− | 1074 | TEKGIELILSTEIVK | 1 | 50 | 1 | 247 |
| | $29_{124}$ | E+G− | 1075 | ASKTLTSAAGATFTY | 1 | 30 | 0 | — |
| | $29_{136}$ | E+G− | 1076 | FTYETLLIATGSSTI | 0 | — | 0 | — |
| | $29_{193}$ | E+G− | 1077 | GGGYIGLELSAALKL | 0 | — | 0 | — |
| | $29_{199}$ | E+G− | 1078 | LELSAALKLNNFDVT | 1 | 133 | 0 | — |
| | $29_{205}$ | E+G− | 1079 | LKLNNFDVTMVYPEP | 0 | — | 0 | — |
| | $29_{222}$ | E+G− | 1080 | MPRLFTAGIAHFYEG | 0 | — | 0 | — |
| | $29_{232}$ | E+G− | 1081 | HFYEGYYASKGINIV | 0 | — | 0 | — |
| | $29_{240}$ | E+G− | 1082 | SKGINIVKGTVASGF | 0 | — | 0 | — |
| | $29_{274}$ | E+G− | 1083 | DANIVIVGVGGRPLT | 0 | — | 0 | — |
| | $29_{303}$ | E+G− | 1084 | KTDTFFETSVAGVYA | 0 | — | 0 | — |
| | $29_{315}$ | E+G− | 1085 | VYAIGDVASFPMKLY | 0 | — | 0 | — |
| | $29_{365}$ | E+G− | 1086 | DYLPYFYSRSFDIAW | 0 | — | 0 | — |
| 30 | $30_{22}$ | E+G− | 1089 | EQFVTPWSFSVASGH | 0 | — | 0 | — |
| | $30_{55}$ | E+G− | 1090 | RDAHYLRGLLPPAIV | 0 | — | 0 | — |
| | $30_{79}$ | E+G− | 1091 | MHNLRQYTVPLQRYI | 0 | — | 0 | — |
| | $30_{87}$ | E+G− | 1092 | VPLQRYIAMMDLQER | 0 | — | 0 | — |
| | $30_{103}$ | E+G− | 1093 | ERLFYKLLIDNVEEL | 0 | — | 0 | — |
| | $30_{115}$ | E+G− | 1094 | EELLPVVYTPVVGEA | 0 | — | 0 | — |
| | $30_{163}$ | E+G− | 1095 | RSIQVIVVTDGERIL | 0 | — | 0 | — |
| | $30_{239}$ | E+G− | 1096 | EEYHELLQEFMNAVK | 0 | — | 0 | — |
| | $30_{257}$ | E+G− | 1097 | GEKVLVQFEDFANHN | 0 | — | 0 | — |
| | $30_{273}$ | E+G− | 1098 | FDLLAKYSKSHLVFN | 0 | — | 0 | — |
| | $30_{285}$ | E+G− | 1099 | VFNDDIQGTASVVLA | 1 | 67 | 0 | — |
| | $30_{295}$ | E+G− | 1100 | SVVLAGLLAALKVIG | 0 | — | 0 | — |
| | $30_{311}$ | E+G− | 1101 | GLADQTYLFLGAGEA | 0 | — | 0 | — |
| | $30_{327}$ | E+G− | 1102 | TGIAELIALEMSKHT | 0 | — | 0 | — |
| | $30_{348}$ | E+G− | 1103 | CRKKIWLVDSKGLLV | 0 | — | 0 | — |
| | $30_{380}$ | E+G− | 1104 | HEPLTTLLEAVQSLK | 0 | — | 0 | — |
| | $30_{386}$ | E+G− | 1105 | LLEAVQSLKPTVLIG | 0 | — | 0 | — |
| | $30_{420}$ | E+G− | 1106 | NEKPVIFSLSNPTSH | 0 | — | 0 | — |
| | $30_{440}$ | E+G− | 1107 | EEAYTWTKGTAVFAS | 0 | — | 0 | — |
| | $30_{481}$ | E+G− | 1108 | GFGLGVVISGAIRVH | 0 | — | 0 | — |
| | $30_{487}$ | E+G− | 1109 | VISGAIRVHDDMLLA | 0 | — | 0 | — |
| | $30_{495}$ | E+G− | 1110 | HDDMLLAASEALAEQ | 0 | — | 0 | — |
| | $30_{521}$ | E+G− | 1111 | FPPFTNIRKISANIA | 0 | — | 0 | — |
| | $30_{527}$ | E+G− | 1112 | IRKISANIAAKVAAK | 0 | — | 0 | — |
| 31 | $31_{6}$ | E−G+ | 691 | QIIRKGFYLTKNVEH | 0 | — | 0 | — |
| | $31_{12}$ | E−G+ | 692 | FYLTKNVEHKGQVDL | 0 | — | 0 | — |
| | $31_{18}$ | E−G+ | 693 | VEHKGQVDLVTETDK | 0 | — | 0 | — |
| | $31_{30}$ | E−G+ | 694 | TDKACEDLIFNHLRK | 0 | — | 0 | — |
| | $31_{36}$ | E−G+ | 695 | DLIFNHLRKLYPDHK | 0 | — | 0 | — |
| 32 | $32_{41}$ | E−G+ | 755 | IEIDSLFEGIDFYST | 0 | — | 1 | 27 |
| | $32_{50}$ | E−G+ | 756 | IDFYSTITRARFEEL | 1 | 20 | 0 | — |
| | $32_{102}$ | E−G+ | 757 | IPKVQQLLQDFFNGK | 0 | — | 0 | — |
| | $32_{126}$ | E−G+ | 758 | EAVAYGAAVQAAILS | 0 | — | 1 | 30 |
| | $32_{147}$ | E−G+ | 759 | VQDLLLLDVTPLSLG | 0 | — | 1 | 47 |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| 33 | $33_1$ | E-G+ | 650 | QEMAYWSLKAAIEIG | 0 | — | 0 | — |
|  | $33_{20}$ | E-G+ | 651 | DAASSLYLFGENLPR | 0 | — | 0 | — |
|  | $33_{60}$ | E-G+ | 652 | GYNISLASMIPDYDT | 0 | — | 0 | — |
|  | $33_{72}$ | E-G+ | 653 | YDTVITNVRRSLAVA | 0 | — | 0 | — |
|  | $33_{116}$ | E-G+ | 654 | LEKIVAILSAFVDAA | 0 | — | 0 | — |
|  | $33_7$ | E-G+ | 655 | NVRRSLAVAKKNHLA | 0 | — | 0 | — |
|  | $33_{14}$ | E-G+ | 656 | VAKKNHLAWNCERCR | 0 | — | 0 | — |
|  | $33_{20}$ | E-G+ | 657 | LAWNCERCRKGESKK | 0 | — | 0 | — |
|  | $33_{33}$ | E-G+ | 658 | KKTVDAILSAFVDAA | 0 | — | 0 | — |
| 34 | $34_1$ | E-G+ | 760 | LMSFSWICACVRAAA | 0 | — | 0 | — |
|  | $34_7$ | E-G+ | 761 | ICACVRAAAVAWEAG | 0 | — | 0 | — |
|  | $34_{39}$ | E-G+ | 762 | VRVKILFTALCHTDV | 0 | — | 0 | — |
|  | $34_{114}$ | E-G+ | 763 | MCDLLRINTDRGVMI | 0 | — | 0 | — |
|  | $34_{140}$ | E-G+ | 764 | KPIFHFVGTSTFSEY | 1 | 40 | 0 | — |
|  | $34_{146}$ | E-G+ | 765 | VGTSTFSEYTVMHVG | 0 | — | 0 | — |
|  | $34_{200}$ | E-G+ | 766 | VAIFGLGAVGLAAAE | 0 | — | 0 | — |
|  | $34_{206}$ | E-G+ | 767 | GAVGLAAAEGARIAG | 0 | — | 0 | — |
|  | $34_{275}$ | E-G+ | 768 | GNINAMIQAFECVHD | 0 | — | 0 | — |
|  | $34_{319}$ | E-G+ | 769 | LKGTFFGNFKPRTDL | 0 | — | 0 | — |
|  | $34_{349}$ | E-G+ | 770 | KFITHSVTFSEINKA | 1 | 50 | 1 | 103 |
|  | $34_{355}$ | E-G+ | 771 | VTFSEINKAFDLMAK | 0 | — | 1 | 103 |
| 35 | $35_1$ | E-G+ | 772 | ALRWNLQMGHSVLPK | 1 | 47 | 0 | — |
|  | $35_{25}$ | E-G+ | 773 | NLDVYDWSIPDDLLA | 1 | 90 | 1 | 67 |
|  | $35_{35}$ | E-G+ | 774 | DDLLAKFSEIKQTRL | 1 | 30 | 0 | — |
|  | $35_{41}$ | E-G+ | 775 | FSEIKQTRLLMGNFI | 0 | — | 0 | — |
|  | $35_{47}$ | E-G+ | 776 | TRLLMGNFIVNKDSV | 0 | — | 0 | — |
| 36 | $36_1$ | E-G+ | 795 | QDFKKVNEIYAKYFP | 0 | — | 0 | — |
|  | $36_7$ | E-G+ | 796 | NEIYAKYFPSPAPAR | 0 | — | 0 | — |
|  | $36_{13}$ | E-G+ | 797 | YFPSPAPARSTYQVA | 0 | — | 0 | — |
|  | $36_{20}$ | E-G+ | 798 | ARSTYQVAALPLDAR | 0 | — | 0 | — |
|  | $36_{29}$ | E-G+ | 779 | LPLDARIEIECIAAL | 0 | — | 0 | — |
| 37 | $37_5$ | E-G+ | 826 | EEAASTLPGLSSSTL | 0 | — | 0 | — |
| 38 | $38_3$ | E-G+ | 908 | STKIFLESSTMESRA | 0 | — | 0 | — |
|  | $38_{53}$ | E-G+ | 909 | CAAVLAASAVVVLVV | 0 | — | 0 | — |
|  | $38_{62}$ | E-G+ | 910 | VVVLVVASGLAGSRV | 0 | — | 0 | — |
|  | $38_{71}$ | E-G+ | 911 | LAGSRVVRVAVDVAT | 0 | — | 0 | — |
|  | $38_{159}$ | E-G+ | 912 | GWYHLFYQYNPEGAV | 0 | — | 0 | — |
|  | $38_{184}$ | E-G+ | 913 | SRDLIHWRHLPLAMV | 0 | — | 0 | — |
|  | $38_{221}$ | E-G+ | 914 | LNMLYTGSTNASVQV | 0 | — | 0 | — |
|  | $38_{302}$ | E-G+ | 915 | IAMVYKTKDFVSYEL | 0 | — | 0 | — |
|  | $38_{308}$ | E-G+ | 916 | TKDFVSYELIPGLLH | 0 | — | 0 | — |
|  | $38_{390}$ | E-G+ | 917 | WGKFYASKTFYDPAK | 0 | — | 0 | — |
|  | $38_{425}$ | E-G+ | 918 | KGWASLMSIPRTVDL | 0 | — | 0 | — |
|  | $38_{480}$ | E-G+ | 919 | LRHATQLDIEAAFRL | 0 | — | 0 | — |
|  | $38_{489}$ | E-G+ | 920 | EAAFRLDHAAVAALN | 0 | — | 0 | — |
|  | $38_{537}$ | E-G+ | 921 | EQTAVYFYVSRGLDG | 0 | — | 0 | — |
|  | $38_{571}$ | E-G+ | 922 | VKRVVGYTVPVLDGE | 0 | — | 0 | — |
|  | $38_{585}$ | E-G+ | 923 | EAFSVRLVDHSIVE | 0 | — | 0 | — |
|  | $38_{617}$ | E-G+ | 924 | EAIYAAAGVYLFNNA | 0 | — | 0 | — |
|  | $38_{625}$ | E-G+ | 925 | VYLFNNATSGTVTVE | 0 | — | 0 | — |
| 39 | $39_{42}$ | E-G+ | 926 | TDIVEVVVSPPYVFL | 0 | — | 0 | — |
|  | $39_{50}$ | E-G+ | 927 | SPPYVFLPTVKDKLR | 0 | — | 0 | — |
|  | $39_{80}$ | E-G+ | 928 | GAFTGEVSAEMLANL | 0 | — | 0 | — |
|  | $39_{86}$ | E-G+ | 929 | VSAEMLANLGIPWVI | 0 | — | 0 | — |
|  | $39_{111}$ | E-G+ | 930 | GESSEFVGDKVAYAL | 0 | — | 1 | 30 |
|  | $39_{118}$ | E-G+ | 931 | GDKVAYALAQGLKVI | 1 | 67 | 1 | 73 |
|  | $39_{146}$ | E-G+ | 932 | STMTVVAEQTKAIAD | 0 | — | 0 | — |
|  | $39_{164}$ | E-G+ | 933 | DWTNVVIAYEPVWAI | 0 | — | 0 | — |
|  | $39_{170}$ | E-G+ | 934 | IAYEPVWAIGTGKVA | 0 | — | 0 | — |
|  | $39_{244}$ | E-G+ | 935 | LKPEFIDIINAATVK | 0 | — | 0 | — |
| 40 | $40_2$ | E-G+ | 963 | VWQHDRVEIIANDQG | 1 | 40 | 0 | — |
|  | $40_8$ | E-G+ | 964 | VEIIANDQGNRTTPS | 1 | 27 | 0 | — |
|  | $40_{19}$ | E-G+ | 965 | TTPSYVAFTDSERLI | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $40_{38}$ | E-G+ | 966 | KNQVAMNPINTVFGE | 0 | — | 0 | — |
| | $40_{44}$ | E-G+ | 967 | NPINTVFGEHLSTCT | 0 | — | 0 | — |
| 41 | $41_{1}$ | E-G+ | 968 | SSTRGWCSRRRAGRG | 0 | — | 0 | — |
| 42 | $42_{17}$ | E-G+ | 969 | EEKQFAAEEISSMVL | 0 | — | 0 | — |
| | $42_{27}$ | E-G+ | 970 | SSMVLIKMREIAEAF | 0 | — | 0 | — |
| | $42_{45}$ | E-G+ | 971 | SIKNAVVTVPAYFND | 0 | — | 0 | — |
| | $42_{69}$ | E-G+ | 972 | GVIAGLNVLRIINEP | 0 | — | 1 | 33 |
| | $42_{76}$ | E-G+ | 973 | VLRIINEPTAAAIAY | 0 | — | 0 | — |
| 43 | $43_{1}$ | E-G+ | 1001 | GILLDFVWYEPLTYN | 0 | — | 0 | — |
| | $43_{44}$ | E-G+ | 1002 | ETMQRLVADRLPNFT | 0 | — | 0 | — |
| | $43_{114}$ | E-G+ | 1003 | GYSKWLYVVPWGFYK | 0 | — | 0 | — |
| | $43_{120}$ | E-G+ | 1004 | YVVPWGFYKAVMHVK | 1 | 20 | 0 | — |
| | $43_{164}$ | E-G+ | 1005 | KFRIDYFDQYLHELK | 0 | — | 0 | — |
| | $43_{185}$ | E-G+ | 1006 | ARVTGYFAWSLLDNF | 0 | — | 0 | — |
| | $43_{191}$ | E-G+ | 1007 | FAWSLLDNFEWRMGF | 1 | 27 | 0 | — |
| 44 | $44_{71}$ | E-G+ | 1036 | FKDDPYIYAFDSLKY | 0 | — | 0 | — |
| | $44_{79}$ | E-G+ | 1037 | AFDSLKYIGIELWQV | 0 | — | 0 | — |
| | $44_{88}$ | E-G+ | 1038 | IELWQVKSGTLFDNI | 0 | — | 0 | — |
| | $44_{96}$ | E-G+ | 1039 | GTLFDNILITDDAAL | 0 | — | 0 | — |
| | $44_{102}$ | E-G+ | 1040 | ILITDDAALAKTFAE | 0 | — | 0 | — |
| 45 | $45_{5}$ | E-G+ | 1041 | KRPPRCCQDLVVLPL | 0 | — | 0 | — |
| 46 | $46_{3}$ | E-G+ | 1042 | RGLLRRARGGPHHRR | 1 | 40 | 0 | — |
| | $46_{19}$ | E-G+ | 1043 | RGAHRRVPLRPLRHR | 0 | — | 1 | 60 |
| | $46_{40}$ | E-G+ | 1044 | EGRRAKLRSAGEVEI | 1 | 177 | 0 | — |
| | $46_{50}$ | E-G+ | 1045 | GEVEIQFRRVKCKYP | 4 | 60 | 0 | — |
| | $46_{67}$ | E-G+ | 1046 | TKVTFHVVGVGPLLH | 1 | 70 | 1 | 160 |
| 47 | $47_{26}$ | E-G+ | 1047 | EDVAVSLAKYTAELS | 0 | — | 0 | — |
| | $47_{41}$ | E-G+ | 1048 | GKFAAERGAFTVVLS | 1 | 30 | 0 | — |
| | $47_{49}$ | E-G+ | 1049 | AFTVVLSGGTLIDTL | 1 | 43 | 0 | — |
| | $47_{96}$ | E-G+ | 1050 | DSNYKLAVDGLLSKV | 1 | 53 | 0 | — |
| | $47_{135}$ | E-G+ | 1051 | TVLKQLVKSGVLAMS | 2 | 22 | 0 | — |
| | $47_{142}$ | E-G+ | 1052 | KSGVLAMSTATGFPR | 1 | 40 | 0 | — |
| | $47_{196}$ | E-G+ | 1053 | PPPQRITFTFPVIKS | 0 | — | 0 | — |
| | $47_{202}$ | E-G+ | 1054 | TFTFPVIKSSAYVAM | 0 | — | 0 | — |
| | $47_{235}$ | E-G+ | 1055 | KTLPLLPTEMAILQD | 0 | — | 0 | — |
| 48 | $48_{2}$ | E-G+ | 1056 | NKLIGARSFFESAKW | 0 | — | 0 | — |
| | $48_{65}$ | E-G+ | 1057 | RAHIAFYQVCFEQKG | 0 | — | 0 | — |
| | $48_{124}$ | E-G+ | 1058 | AALNGVFVSTAAGNI | 0 | — | 0 | — |
| | $48_{149}$ | E-G+ | 1059 | APWLLTVGASTSDRR | 0 | — | 0 | — |
| | $48_{158}$ | E-G+ | 1060 | STSDRRFAATVKLGS | 0 | — | 0 | — |
| | $48_{235}$ | E-G+ | 1061 | VLRAGAFGMIVVAPA | 0 | — | 0 | — |
| | $48_{241}$ | E-G+ | 1062 | FGMIVVAPAVFGPVI | 0 | — | 0 | — |
| | $48_{269}$ | E-G+ | 1063 | YAVGQKIKAYLEAES | 0 | — | 1 | 297 |
| | $48_{335}$ | E-G+ | 1064 | VPGVVDIVLQPKEVM | 0 | — | 0 | — |
| | $48_{362}$ | E-G+ | 1065 | CPHLAGIAALLKNAH | 0 | — | 0 | — |
| | $48_{429}$ | E-G+ | 1066 | GLVYNLTAAEYIPYL | 0 | — | 0 | — |
| | $48_{487}$ | E-G+ | 1067 | KADSVVNASRAVTNV | 0 | — | 0 | — |
| | $48_{526}$ | E-G+ | 1068 | KLTFKALEEVLNYTV | 0 | — | 0 | — |
| | $48_{533}$ | E-G+ | 1069 | EEVLNYTVTVKTAAV | 0 | — | 0 | — |
| | $48_{552}$ | E-G+ | 1070 | IEGQLKWVSSKHIVR | 0 | — | 0 | — |
| | $48_{558}$ | E-G+ | 1071 | WVSSKHIVRSPILIL | 0 | — | 0 | — |
| 49 | $49_{1}$ | E-G+ | 1121 | ELRKTYNLLDAVSRH | 4 | 847 | 1 | 100 |
| | $49_{18}$ | E-G+ | 1122 | QVYPRSWSAVMLTFD | 2 | 602 | 0 | — |
| | $49_{26}$ | E-G+ | 1123 | AVMLTFDNAGMWNVR | 3 | 899 | 1 | 503 |
| | $49_{42}$ | E-G+ | 1124 | NVWERHYLAGEMTLM | 1 | 130 | 0 | — |
| | $49_{50}$ | E-G+ | 1125 | GEQLYISVISPARSL | 0 | — | 1 | 80 |
| 50 | $50_{10}$ | E-G+ | 1126 | DSSEYAFRTAVSSSM | 0 | — | 0 | — |
| | $50_{44}$ | E-G+ | 1127 | IGNLRLDNTTLIDKD | 1 | 40 | 0 | — |
| | $50_{88}$ | E-G+ | 1128 | EIPMIQNILSRSQIF | 0 | — | 2 | 158 |
| | $50_{97}$ | E-G+ | 1129 | SRSQIFDGIPNLMSL | 0 | — | 1 | 87 |
| | $50_{103}$ | E-G+ | 1130 | DGIPNLMSLDNVVKI | 0 | — | 2 | 158 |

TABLE 4-continued

Panel of 822 peptides predicted from 93 novel Timothy Grass (TG)
proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $50_{123}$ | E-G+ | 1131 | IWVNVEYDSFYREHG | 0 | — | 0 | — |
| | $50_{150}$ | E-G+ | 1132 | EFPVTWVSSPEVALL | 0 | — | 1 | 97 |
| | $50_{158}$ | E-G+ | 1133 | SPEVALLKSLAGKLR | 1 | 27 | 1 | 87 |
| | $50_{168}$ | E-G+ | 1134 | AGKLRNSTKLIFRFL | 0 | — | 0 | — |
| | $50_{174}$ | E-G+ | 1135 | STKLIFRFLREDLVE | 1 | 30 | 0 | — |
| | $50_{196}$ | E-G+ | 1136 | GELLKDLKSIKAFAS | 0 | — | 1 | 43 |
| | $50_{202}$ | E-G+ | 1137 | LKSIKAFASGILVPK | 0 | — | 0 | — |
| 51 | $51_{15}$ | E-G+ | 1138 | CEGILKLLETHLVPS | 0 | — | 0 | — |
| | $51_{21}$ | E-G+ | 1139 | LLETHLVPSSTAPES | 0 | — | 1 | 47 |
| | $51_{33}$ | E-G+ | 1140 | PESKVFYLKMKGDYH | 1 | 27 | 1 | 53 |
| | $51_{67}$ | E-G+ | 1141 | MNSYKAAQDIALADL | 0 | — | 1 | 43 |
| | $51_{82}$ | E-G+ | 1142 | APTHPIRLGLALKIS | 0 | — | 0 | — |
| 52 | $52_{1}$ | E-G+ | 1143 | LLGLLAPLASAQLSR | 0 | — | 1 | 33 |
| | $52_{23}$ | E-G+ | 1144 | PDAEKIVAAVIEKKL | 1 | 20 | 0 | — |
| | $52_{45}$ | E-G+ | 1145 | AGLLRLLFHDCFANG | 1 | 113 | 1 | 37 |
| | $52_{60}$ | E-G+ | 1146 | CDASILIDPLSNQSA | 3 | 91 | 5 | 151 |
| | $52_{229}$ | E-G+ | 1147 | IDSSYFANVLAKKMP | 1 | 50 | 1 | 50 |
| | $52_{266}$ | E-G+ | 1148 | KPNDFMPTFAKAMEK | 0 | — | 1 | 33 |
| | $52_{277}$ | E-G+ | 1149 | PTFAKAMEKLSVLKV | 2 | 53 | 2 | 62 |
| | $52_{309}$ | E-G+ | 1150 | GGSVIRISSANPEDL | 1 | 70 | 2 | 72 |
| | $52_{343}$ | E-G+ | 1151 | DPWHVKTLKAAGAAH | 0 | — | 0 | — |
| 53 | $53_{1}$ | E-G+ | 1152 | WSEIQTLKPNLIGPF | 0 | — | 1 | 103 |
| | $53_{31}$ | E-G+ | 1153 | KFMTLAGFLDYAKAS | 0 | — | 0 | — |
| | $53_{46}$ | E-G+ | 1154 | NISGILIGIEHAAYL | 0 | — | 0 | — |
| | $53_{57}$ | E-G+ | 1155 | AAYLATRGLDVVDAV | 1 | 880 | 1 | 1030 |
| | $53_{64}$ | E-G+ | 1156 | GLDVVDAVSNALIKS | 1 | 23 | 0 | — |
| | $53_{84}$ | E-G+ | 1157 | TKQQVFIQSEDPPVL | 3 | 42 | 0 | — |
| | $53_{96}$ | E-G+ | 1158 | PVLSAFKKFPKFNRV | 1 | 53 | 0 | — |
| | $53_{103}$ | E-G+ | 1159 | KFPKFNRVFEIEFDI | 1 | 30 | 3 | 499 |
| | $53_{126}$ | E-G+ | 1160 | VEIKEFANAVKLRRS | 1 | 87 | 1 | 797 |
| | $53_{135}$ | E-G+ | 1161 | VKLRRSSAAQVDGFY | 3 | 104 | 0 | — |
| | $53_{147}$ | E-G+ | 1162 | GFYLTGFNAVVERLR | 0 | — | 0 | — |
| | $53_{170}$ | E-G+ | 1163 | GVLKNEFMSLAFDYW | 1 | 83 | 0 | — |
| | $53_{202}$ | E-G+ | 1164 | GLVTEFPSTAAAYFR | 1 | 63 | 1 | 153 |
| 54 | $54_{39}$ | E-G+ | 1165 | NIVVNVFNQLDQPLL | 1 | 43 | 0 | — |
| | $54_{50}$ | E-G+ | 1166 | QPLLFTWNGIQHRKN | 0 | — | 0 | — |
| | $54_{93}$ | E-G+ | 1167 | IGSFFYFPSIGMQRT | 5 | 447 | 4 | 183 |
| | $54_{110}$ | E-G+ | 1168 | GYGLISVVSRLLIPV | 0 | — | 0 | — |
| | $54_{116}$ | E-G+ | 1169 | VVSRLLIPVPFDPPA | 1 | 307 | 1 | 133 |
| 55 | $55_{14}$ | E-G- | 685 | SVFKKFPKFRRVLVI | 0 | — | 0 | — |
| | $55_{20}$ | E-G- | 686 | PKFRRVLVIDPVISG | 0 | — | 0 | — |
| | $55_{40}$ | E-G- | 687 | IGEIKGFADAVMVSR | 0 | — | 1 | 167 |
| | $55_{46}$ | E-G- | 688 | FADAVMVSRGSLVRV | 0 | — | 0 | — |
| | $55_{52}$ | E-G- | 689 | VSRGSLVRVNGFFLT | 0 | — | 0 | — |
| | $55_{60}$ | E-G- | 690 | VNGFFLTGFNDLVTE | 0 | — | 1 | 903 |
| 56 | $56_{2}$ | E-G- | 722 | KELGGKILRQPGPLP | 0 | — | 0 | — |
| | $56_{8}$ | E-G- | 723 | ILRQPGPLPGLNTKI | 0 | — | 0 | — |
| | $56_{15}$ | E-G- | 724 | LRGLNTKIASFLDPD | 0 | — | 0 | — |
| | $56_{21}$ | E-G- | 725 | KIASFLDPDGWKVVL | 0 | — | 1 | 343 |
| | $56_{30}$ | E-G- | 726 | GWKVVLVDHADFLKE | 0 | — | 0 | — |
| 57 | $57_{3}$ | E-G- | 727 | QDNAKIVQIDSSIQA | 0 | — | 0 | — |
| | $57_{29}$ | E-G- | 728 | RLVCLRVHPTFTLLH | 0 | — | 0 | — |
| | $57_{36}$ | E-G- | 729 | HPTFTLLHPTEVVVA | 0 | — | 0 | — |
| | $57_{45}$ | E-G- | 730 | TEVVVAFTAINGSRQ | 0 | — | 0 | — |
| | $57_{91}$ | E-G- | 731 | LVNRFEISQVSKCLV | 0 | — | 0 | — |
| 58 | $58_{13}$ | E-G- | 642 | ADPCSEYFVEAYLNN | 0 | — | 0 | — |
| | $58_{19}$ | E-G- | 643 | YFVEAYLNNPLVQKA | 0 | — | 0 | — |
| | $58_{30}$ | E-G- | 644 | VQKAIHANTALNYPW | 0 | — | 0 | — |
| | $58_{62}$ | E-G- | 645 | PSMLAHIKALVTTGI | 0 | — | 0 | — |
| | $58_{80}$ | E-G- | 646 | LYSGDLDAMVPVTAS | 0 | — | 0 | — |
| | $58_{14}$ | E-G- | 647 | LNYPWTGCRTRTYNL | 0 | — | 0 | — |
| | $58_{26}$ | E-G- | 648 | YNLRRFGASPPSMLA | 0 | — | 0 | — |
| | $58_{41}$ | E-G- | 649 | HIKALVTTASASGCT | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactivity IgE/IgG | SEQ ID NO | Sequence | Total response IL-5 Events | SFC | Total response IFNg Events | SFC |
|---|---|---|---|---|---|---|---|---|
| 59 | $59_{47}$ | E-G- | 737 | VKKIVTVLNEAEVPS | 0 | — | 0 | — |
|  | $59_{62}$ | E-G- | 738 | EDAVEVVSPPFVFL | 0 | — | 0 | — |
|  | $59_{69}$ | E-G- | 739 | VSPPFVFLQQAKALL | 0 | — | 0 | — |
|  | $59_{75}$ | E-G- | 740 | FLQQAKALLRPDFAV | 0 | — | 1 | 33 |
|  | $59_{81}$ | E-G- | 741 | ALLRPDFAVAAQNCW | 0 | — | 1 | 23 |
|  | $59_{100}$ | E-G- | 742 | GAFTGEISAEMLVNL | 0 | — | 0 | — |
|  | $59_{106}$ | E-G- | 743 | ISAEMLVNLQVPWVI | 0 | — | 1 | 37 |
|  | $59_{132}$ | E-G- | 744 | ESNDFVADKVAYALA | 0 | — | 0 | — |
|  | $59_{138}$ | E-G- | 745 | ADKVAYALAQGLKVI | 1 | 47 | 2 | 45 |
|  | $59_{166}$ | E-G- | 746 | TTMEVVAAQTKAIAE | 0 | — | 1 | 23 |
|  | $59_{185}$ | E-G- | 747 | WTNVVLAYEPVWAIG | 1 | 20 | 0 | — |
|  | $59_{216}$ | E-G- | 748 | LRKWLHANVGPAVAE | 0 | — | 2 | 138 |
|  | $59_{266}$ | E-G- | 749 | PEFVDIIKSATVKSS | 0 | — | 1 | 137 |
| 60 | $60_{26}$ | E-G- | 821 | EDSHFVVELTYNYGV | 0 | — | 0 | — |
|  | $60_{122}$ | E-G- | 822 | RAIKFYEKAFGMELL | 0 | — | 0 | — |
|  | $60_{141}$ | E-G- | 823 | NPQYKYTIAMMGYGP | 0 | — | 0 | — |
|  | $60_{158}$ | E-G- | 824 | KNAVLELTYNYGVKE | 0 | — | 0 | — |
|  | $60_{224}$ | E-G- | 825 | DGWKSVFVDNLDFLK | 0 | — | 0 | — |
| 61 | $61_{1}$ | E-G- | 856 | LQSKNCILYLCSIMI | 0 | — | 0 | — |
|  | $61_{7}$ | E-G- | 857 | ILYLCSIMICNCKVS | 0 | — | 0 | — |
|  | $61_{13}$ | E-G- | 858 | IMICNCKVSKVLNTY | 0 | — | 0 | — |
|  | $61_{19}$ | E-G- | 859 | KVSKVLNTYIFLLYL | 1 | 27 | 0 | — |
| 62 | $62_{11}$ | E-G- | 880 | YQPAAMRRLSLILLA | 1 | 63 | 0 | — |
|  | $62_{17}$ | E-G- | 881 | RRLSLILLAAAALLA | 0 | — | 0 | — |
|  | $62_{23}$ | E-G- | 882 | LLAAAALLAAAVSAE | 0 | — | 0 | — |
|  | $62_{53}$ | E-G- | 883 | CPRAERIIAEVVQSK | 0 | — | 0 | — |
|  | $62_{119}$ | E-G- | 884 | AFDAVVRSKLALELE | 0 | — | 0 | — |
|  | $62_{140}$ | E-G- | 885 | CADILAIASRVLVTM | 1 | 43 | 0 | — |
|  | $62_{185}$ | E-G- | 886 | NFTVGRIIELFTAKG | 4 | 200 | 6 | 223 |
|  | $62_{191}$ | E-G- | 887 | IIELFTAKGFTVQEM | 2 | 298 | 4 | 179 |
|  | $62_{200}$ | E-G- | 888 | FTVQEMVALSGAHTL | 0 | — | 1 | 537 |
|  | $62_{264}$ | E-G- | 889 | IAAFNDIMSSSVLSS | 0 | — | 0 | — |
|  | $62_{276}$ | E-G- | 890 | FDNIYSVNIERGLGL | 0 | — | 1 | 73 |
|  | $62_{314}$ | E-G- | 891 | NTDFFEDFAKAIEKL | 0 | — | 0 | — |
| 63 | $63_{5}$ | E-G- | 979 | YPHMLLILLLLHGAN | 0 | — | 0 | — |
|  | $63_{11}$ | E-G- | 980 | ILLLLHGANAALDEP | 0 | — | 1 | 47 |
|  | $63_{51}$ | E-G- | 981 | ESSLYAYQFAMSNGL | 0 | — | 0 | — |
|  | $63_{86}$ | E-G- | 982 | SGLRLDKSTLIAEVF | 0 | — | 0 | — |
|  | $63_{114}$ | E-G- | 983 | IHGWFAVDFTAAELV | 1 | 120 | 2 | 227 |
| 64 | $64_{17}$ | E-G- | 1008 | EIPTISYSDLYQLAG | 0 | — | 0 | — |
|  | $64_{23}$ | E-G- | 1009 | YSDLYQLAGVVAVEV | 0 | — | 0 | — |
|  | $64_{69}$ | E-G- | 1010 | DHLRQVFGKQMGLSD | 0 | — | 0 | — |
|  | $64_{111}$ | E-G- | 1011 | KNPLKFDNTYFTELL | 1 | 100 | 1 | 47 |
|  | $64_{159}$ | E-G- | 1012 | KAFFEDYKEAHLRLS | 0 | — | 0 | — |
| 65 | $65_{22}$ | E-G- | 1116 | FSCDSAYQVTYIVRG | 1 | 23 | 1 | 47 |
|  | $65_{28}$ | E-G- | 1117 | YQVTYIVRGSGRVQV | 1 | 87 | 1 | 367 |
|  | $65_{55}$ | E-G- | 1118 | IEGGSLFIVPRFHVV | 1 | 130 | 1 | 113 |
|  | $65_{77}$ | E-G- | 1119 | GMEWFSIITTPNPIF | 0 | — | 0 | — |
|  | $65_{96}$ | E-G- | 1120 | GKTSVWKAISPEVLE | 0 | — | 0 | — |
| 66 | $66_{4}$ | n.d. | 1355 | SCRGRCPCSLRTPAW | 0 | — | 0 | — |
|  | $66_{12}$ | n.d. | 1356 | SLRTPAWGSCSRMAP | 0 | — | 0 | — |
|  | $66_{18}$ | n.d. | 1357 | WGSCSRMAPCNCRCP | 0 | — | 0 | — |
|  | $66_{28}$ | n.d. | 1358 | NCRCPCSTRGARRRL | 0 | — | 0 | — |
|  | $66_{34}$ | n.d. | 1359 | STRGARRRLPGRTSS | 0 | — | 0 | — |
| 67 | $67_{9}$ | n.d. | 1388 | TAPTSRRSPSAPSPH | 0 | — | 0 | — |
|  | $67_{41}$ | n.d. | 1389 | TRTCISTRRIPSRPT | 0 | — | 0 | — |
|  | $67_{58}$ | n.d. | 1390 | PWSTCRAARSPTPSA | 0 | — | 0 | — |
|  | $67_{96}$ | n.d. | 1391 | DRREIWLSEMVAWVG | 0 | — | 0 | — |
|  | $67_{103}$ | n.d. | 1392 | SEMVAWVGLQLAFWI | 0 | — | 0 | — |
| 68 | $68_{8}$ | n.d. | 1360 | PWRPPRRWSCCPLPW | 0 | — | 0 | — |
|  | $68_{16}$ | n.d. | 1361 | SCCPLPWPGTRRWWF | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $68_{24}$ | n.d. | 1362 | GTRRWWFRCHQPPSS | 0 | — | 0 | — |
| | $68_{30}$ | n.d. | 1363 | FRCHQPPSSRTAPGS | 0 | — | 0 | — |
| | $68_{42}$ | n.d. | 1364 | PGSSRSLYGSPSTSC | 0 | — | 0 | — |
| 69 | $69_1$ | n.d. | 1393 | VKVAPAALVNVLEAR | 0 | — | 0 | — |
| | $69_8$ | n.d. | 1394 | LVNVLEARSALTISV | 0 | — | 0 | — |
| | $69_{14}$ | n.d. | 1395 | ARSALTISVLRISSM | 0 | — | 0 | — |
| | $69_{20}$ | n.d. | 1396 | ISVLRISSMPFSVYH | 0 | — | 0 | — |
| | $69_{53}$ | n.d. | 1397 | LAAFWGKRYPLLSAG | 0 | — | 0 | — |
| 70 | $70_1$ | n.d. | 1398 | SSPSCAPESTHAVRA | 0 | — | 0 | — |
| | $70_7$ | n.d. | 1399 | PESTHAVRALPSTHT | 0 | — | 0 | — |
| | $70_{13}$ | n.d. | 1400 | VRALPSTHTARILLR | 0 | — | 0 | — |
| | $70_{19}$ | n.d. | 1401 | THTARILLRSTTANV | 0 | — | 0 | — |
| | $70_{25}$ | n.d. | 1402 | LLRSTTANVSGCKDR | 0 | — | 0 | — |
| 71 | $71_2$ | n.d. | 1403 | VQVPGGHQGDLPRGE | 0 | — | 0 | — |
| | $71_{22}$ | n.d. | 1404 | LPGAAGEVCRRRRRR | 0 | — | 0 | — |
| | $71_{45}$ | n.d. | 1405 | GQGQVDRAQGVVGSH | 0 | — | 0 | — |
| | $71_{54}$ | n.d. | 1406 | GVVGSHLEDRHSRQA | 0 | — | 0 | — |
| | $71_{60}$ | n.d. | 1407 | LEDRHSRQAHRPLHR | 0 | — | 0 | — |
| 72 | $72_8$ | n.d. | 1365 | KHLIYVTGWSVYTEI | 0 | — | 0 | — |
| | $72_{14}$ | n.d. | 1366 | TGWSVYTEITLLRDA | 0 | — | 0 | — |
| | $72_{49}$ | n.d. | 1367 | SEGVRVLMLVWDDRT | 0 | — | 0 | — |
| | $72_{100}$ | n.d. | 1368 | DDSGSIVQDLQISTM | 0 | — | 0 | — |
| | $72_{109}$ | n.d. | 1369 | LQISTMFTHHQKIVV | 0 | — | 0 | — |
| | $72_{136}$ | n.d. | 1370 | RRRRIMSFVGGLDLC | 0 | — | 0 | — |
| | $72_{202}$ | n.d. | 1371 | PVAWDVLYNFEQRWR | 0 | — | 0 | — |
| | $72_{220}$ | n.d. | 1372 | GKDLLIQLRDLADEI | 0 | — | 0 | — |
| | $72_{248}$ | n.d. | 1373 | AWNVQLFRSIDGGAA | 0 | — | 0 | — |
| | $72_{291}$ | n.d. | 1374 | DAYICAIRRAKSFIY | 1 | 40 | 1 | 77 |
| | $72_{297}$ | n.d. | 1375 | IRRAKSFIYIENQYF | 0 | — | 0 | — |
| | $72_{303}$ | n.d. | 1376 | FIYIENQYFLGSSYC | 0 | — | 0 | — |
| | $72_{351}$ | n.d. | 1377 | RFTVYVVVPMWPEGI | 0 | — | 0 | — |
| | $72_{379}$ | n.d. | 1378 | RRTMEMMYTDIAQAI | 0 | — | 0 | — |
| | $72_{385}$ | n.d. | 1379 | MYTDIAQAIQAKGID | 0 | — | 0 | — |
| | $72_{433}$ | n.d. | 1380 | DYLKAQQNRRFMIYV | 1 | 190 | 1 | 33 |
| | $72_{443}$ | n.d. | 1381 | FMIYVHTKMMIVDDE | 0 | — | 0 | — |
| | $72_{453}$ | n.d. | 1382 | IVDDEYIIVGSANIN | 0 | — | 0 | — |
| | $72_{484}$ | n.d. | 1383 | YQPYHLAASRPARGQ | 0 | — | 0 | — |
| | $72_{497}$ | n.d. | 1384 | GQVHGFRMALWYEHL | 0 | — | 0 | — |
| | $72_{503}$ | n.d. | 1385 | RMALWYEHLGMVDEA | 0 | — | 0 | — |
| | $72_{526}$ | n.d. | 1386 | CVRKVNAMADRYWNL | 0 | — | 0 | — |
| | $72_{570}$ | n.d. | 1387 | LPGVEFFPDTQARIL | 0 | — | 0 | — |
| 73 | $73_{42}$ | n.d. | 1408 | HTFKSLFESWPVSST | 0 | — | 0 | — |
| | $73_{127}$ | n.d. | 1409 | DCYIVLYTYHSGEKR | 0 | — | 0 | — |
| | $73_{144}$ | n.d. | 1410 | FYLTYWIGKDSVLED | 0 | — | 0 | — |
| | $73_{159}$ | n.d. | 1411 | QHMALQIATTIWNSM | 0 | — | 0 | — |
| | $73_{187}$ | n.d. | 1412 | EPPQFIALFQPMVIL | 0 | — | 0 | — |
| | $73_{219}$ | n.d. | 1413 | KDETYSGTGIALVHI | 0 | — | 0 | — |
| | $73_{225}$ | n.d. | 1414 | GTGIALVHIHGTSIH | 0 | — | 0 | — |
| | $73_{240}$ | n.d. | 1415 | NNKTLQVDAVSISLS | 0 | — | 0 | — |
| | $73_{256}$ | n.d. | 1416 | TDCFVLQSGNSMFTW | 0 | — | 0 | — |
| | $73_{279}$ | n.d. | 1417 | QQQWAAKVAEFLKPG | 0 | — | 0 | — |
| | $73_{326}$ | n.d. | 1418 | DVLREPHLYTFSFRN | 1 | 77 | 0 | — |
| | $73_{343}$ | n.d. | 1419 | LEVTEVFNFSQDDLL | 1 | 63 | 0 | — |
| | $73_{349}$ | n.d. | 1420 | FNFSQDDLLTEDVMI | 1 | 90 | 0 | — |
| | $73_{360}$ | n.d. | 1421 | DVMILDTHAEVFVWM | 0 | — | 0 | — |
| | $73_{419}$ | n.d. | 1422 | CFFRTYFSWDNTRSV | 0 | — | 0 | — |
| | $73_{437}$ | n.d. | 1423 | NSFQKKLSLLFGMRS | 0 | — | 0 | — |
| | $73_{466}$ | n.d. | 1424 | RASALAALSSAFNPS | 0 | — | 0 | — |
| | $73_{500}$ | n.d. | 1425 | QRASALAALSSSLNP | 0 | — | 0 | — |
| | $73_{531}$ | n.d. | 1426 | SQRAAAVAALSNVLT | 0 | — | 0 | — |
| | $73_{537}$ | n.d. | 1427 | VAALSNVLTAEGSTL | 0 | — | 0 | — |
| | $73_{601}$ | n.d. | 1428 | ETTFSYDRLISKSTD | 0 | — | 0 | — |
| | $73_{622}$ | n.d. | 1429 | YKRRETYLSDSEFET | 0 | — | 0 | — |
| | $73_{632}$ | n.d. | 1430 | SEFETVFGVTKEEFY | 0 | — | 0 | — |
| | $73_{660}$ | n.d. | 1431 | SRSFLKHSLLRTQRL | 1 | 73 | 0 | — |
| | $73_{666}$ | n.d. | 1432 | HSLLRTQRLHKFLVC | 1 | 87 | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $73_{674}$ | n.d. | 1433 | LHKFLVCSSMIGVMA | 1 | — | 0 | — |
| | $73_{694}$ | n.d. | 1434 | SGNLVMFQMQDHQLI | 1 | 157 | 0 | — |
| | $73_{706}$ | n.d. | 1435 | QLIYPLISPSFLVYS | 1 | 200 | 0 | — |
| | $73_{712}$ | n.d. | 1436 | ISPSFLVYSFFVHDL | 1 | 77 | 0 | — |
| 74 | $74_{5}$ | n.d. | 1437 | ERLIYQTANSRLCSV | 0 | — | 0 | — |
| | $74_{12}$ | n.d. | 1438 | ANSRLCSVLPKEEFY | 0 | — | 0 | — |
| | $74_{19}$ | n.d. | 1439 | VLPKEEFYQQPRWKQ | 0 | — | 0 | — |
| | $74_{25}$ | n.d. | 1440 | FYQQPRWKQELQKRK | 0 | — | 0 | — |
| 75 | $75_{2}$ | n.d. | 1441 | TGAAAAMTTTIRSTA | 0 | — | 0 | — |
| | $75_{10}$ | n.d. | 1442 | TTIRSTATARPRAIV | 0 | — | 0 | — |
| 76 | $76_{11}$ | E-G- | 1172 | NIWADDLAASLSTLE | 0 | — | 1 | 390 |
| | $76_{17}$ | E-G- | 1173 | IAIAFLSVSNNYEYI | 1 | 47 | 0 | — |
| | $76_{24}$ | E-G- | 1174 | VSNNYEYILSDKLVV | 0 | — | 0 | — |
| | $76_{33}$ | E-G- | 1175 | KDKLVVSTSCSLMHT | 0 | — | 0 | — |
| | $76_{40}$ | E-G- | 1176 | TSCSLMHTAVDLVNE | 1 | 160 | 0 | — |
| | $76_{55}$ | E-G- | 1177 | TKLDSEIKSWLAFAA | 1 | 200 | 1 | 323 |
| | $76_{61}$ | E-G- | 1178 | IKSWLAFAAQKVVEV | 0 | — | 0 | — |
| | $76_{71}$ | E-G- | 1179 | KVVEVNALGKALVGL | 0 | — | 0 | — |
| | $76_{85}$ | E-G- | 1280 | LKDEAYFAANAAAQA | 1 | 203 | 1 | 153 |
| | $76_{175}$ | E-G- | 1281 | EAYVSAIKEEISKVV | 0 | — | 0 | — |
| | $76_{185}$ | E-G- | 1182 | ISKVVKIQEELDIDV | 0 | — | 0 | — |
| | $76_{210}$ | E-G- | 1183 | MVEYFGEQLSGFAFT | 0 | — | 0 | — |
| | $76_{218}$ | E-G- | 1184 | LSGFAFTANGWVQSY | 0 | — | 0 | — |
| | $76_{250}$ | E-G- | 1185 | NPMTVFWSKMAQSMT | 2 | 138 | 0 | — |
| 77 | $77_{3}$ | E-G- | 1186 | EGPLMLYVSKMIPAS | 0 | — | 0 | — |
| | $77_{19}$ | E-G- | 1187 | KGRFFAFGRVFAGRV | 0 | — | 0 | — |
| | $77_{79}$ | E-G- | 1188 | GNTVALVGLDQFITK | 0 | — | 0 | — |
| | $77_{85}$ | E-G- | 1189 | VGLDQFITKNATLTG | 0 | — | 0 | — |
| | $77_{107}$ | E-G- | 1190 | PIRAMKFSVSPVVRV | 0 | — | 0 | — |
| | $77_{179}$ | E-G- | 1191 | FMGGAEIIVSPPVVS | 0 | — | 0 | — |
| | $77_{188}$ | E-G- | 1192 | SPPVVSFRETVLDKS | 1 | 107 | 0 | — |
| | $77_{212}$ | E-G- | 1193 | NKHNRLYMEARPLEE | 1 | 107 | 0 | — |
| | $77_{338}$ | E-G- | 1194 | PTARRVIFASQLTAK | 0 | — | 0 | — |
| | $77_{351}$ | E-G- | 1195 | AKPRLLEPVYLVEIQ | 0 | — | 0 | — |
| | $77_{357}$ | E-G- | 1196 | EPVYLVEIQAPEGAL | 0 | — | 0 | — |
| | $77_{395}$ | E-G- | 1197 | PLYNIKAYLPVIESF | 0 | — | 0 | — |
| | $77_{403}$ | E-G- | 1198 | LPVIESFGFSATLRA | 0 | — | 1 | 333 |
| | $77_{409}$ | E-G- | 1199 | FGFSATLRAATSGQA | 0 | — | 0 | — |
| 78 | $78_{5}$ | E-G- | 1200 | SLKLHKACEAFNPYD | 0 | — | 0 | — |
| | $78_{13}$ | E-G- | 1201 | EAFDPYYGKISLSKV | 0 | — | 0 | — |
| | $78_{25}$ | E-G- | 1202 | SKVRSFLTEAKAKHI | 0 | — | 0 | — |
| | $78_{31}$ | E-G- | 1203 | LTEAKAKHIEWNCDV | 0 | — | 0 | — |
| | $78_{116}$ | E-G- | 1204 | KEKRWNAALTSISAS | 0 | — | 0 | — |
| | $78_{133}$ | E-G- | 1205 | GSAYVDLGSLLAERT | 0 | — | 0 | — |
| | $78_{1}$ | E-G- | 1206 | RHLARQFIPHLHQRF | 0 | — | 0 | — |
| | $78_{7}$ | E-G- | 1207 | FIPHLHQRFIHPPIH | 0 | — | 0 | — |
| | $78_{24}$ | E-G- | 1208 | NTMENLSSTIFSFVI | 0 | — | 0 | — |
| | $78_{32}$ | E-G- | 1209 | TIFSFVILLSASASL | 0 | — | 0 | — |
| | $78_{38}$ | E-G- | 1210 | ILLSASASLVVAGDP | 0 | — | 0 | — |
| | $78_{85}$ | E-G- | 1211 | ELAEMEVSAAFHLFS | 0 | — | 2 | 217 |
| | $78_{92}$ | E-G- | 1212 | SAAFHLFSMAVTAAR | 0 | — | 0 | — |
| | $78_{98}$ | E-G- | 1213 | FSMAVTAARSQQWND | 0 | — | 0 | — |
| | $78_{143}$ | E-G- | 1214 | KISLSKVRSFLTEAK | 0 | — | 1 | 783 |
| 79 | $79_{132}$ | E-G- | 1215 | QQYTAALSPILFECL | 1 | 183 | 0 | — |
| | $79_{138}$ | E-G- | 1216 | LSPILFECLIHPMLG | 1 | 83 | 0 | — |
| | $79_{160}$ | E-G- | 1217 | VEDNLVKLKNVLNVY | 1 | 100 | 0 | — |
| | $79_{166}$ | E-G- | 1218 | KLKNVLNVYEARLTK | 0 | — | 0 | — |
| | $79_{11}$ | E-G- | 1219 | EVYEARLTKFKYLAG | 0 | — | 1 | 47 |
| | $79_{18}$ | E-G- | 1220 | TKFKYLAGDYLSLAD | 1 | 37 | 0 | — |
| | $79_{24}$ | E-G- | 1221 | AGDYLSLADLNHVST | 0 | — | 0 | — |
| | $79_{57}$ | E-G- | 1222 | VKAWWTDLLAKPSVQ | 1 | 100 | 1 | 23 |
| 80 | $80_{1}$ | E-G- | 1223 | KLRFTCLSSTGSSCL | 1 | 133 | 0 | — |
| | $80_{7}$ | E-G- | 1224 | LSSTGSSCLFVLILF | 1 | 147 | 1 | 63 |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| 81 | $81_1$ | E-G- | 1225 | EKLKKVLEVYEARLS | 2 | 100 | 0 | — |
|  | $81_{18}$ | E-G- | 1226 | SYLAGDFVSFADLNH | 1 | 40 | 0 | — |
|  | $81_{24}$ | E-G- | 1227 | FVSFADLNHFPKTFY | 0 | — | 0 | — |
|  | $81_{33}$ | E-G- | 1228 | FPKTFYFMATPHASL | 0 | — | 0 | — |
|  | $81_{53}$ | E-G- | 1229 | HVKAWWERIMARPAV | 0 | — | 0 | — |
|  | $81_{61}$ | E-G- | 1230 | IMARPAVKKIAAAMV | 0 | — | 0 | — |
| 82 | $82_{33}$ | E-G- | 1231 | KRKVRGFWRVHQISA | 0 | — | 0 | — |
|  | $82_{39}$ | E-G- | 1232 | FWRVHQISARMAPVK | 0 | — | 0 | — |
|  | $82_{49}$ | E-G- | 1233 | MAPVKLYGATLSWNV | 0 | — | 0 | — |
|  | $82_{109}$ | E-G- | 1234 | GDLYIFESRAICKYA | 1 | 290 | 0 | — |
|  | $82_{150}$ | E-G- | 1235 | EANQYTAALGPILFE | 0 | — | 0 | — |
| 83 | $83_5$ | E-G- | 1236 | ACSLFLNYAVSFNYF | 1 | 57 | 0 | — |
|  | $83_{12}$ | E-G- | 1237 | YAVSFNYFVCNLLQE | 1 | 70 | 1 | 37 |
|  | $83_{22}$ | E-G- | 1238 | NLLQERLKKLKSEHG | 1 | 83 | 1 | 47 |
|  | $83_{54}$ | E-G- | 1239 | GMTGMLWETSLLDPE | 1 | 107 | 0 | — |
|  | $83_{96}$ | E-G- | 1240 | PEGLLWLLLTGKVPT | 1 | 93 | 1 | 33 |
|  | $83_{130}$ | E-G- | 1241 | YVYKAIDALPVTAHP | 0 | — | 0 | — |
|  | $83_{147}$ | E-G- | 1242 | QFTTGVMALQVESEF | 0 | — | 0 | — |
|  | $83_{180}$ | E-G- | 1243 | EDCLNLIARLPQVAS | 0 | — | 0 | — |
|  | $83_{186}$ | E-G- | 1244 | IARLPQVASYVYRRI | 1 | 187 | 1 | 33 |
|  | $83_{209}$ | E-G- | 1245 | ADNSLDYAANFSHML | 1 | 130 | 1 | 53 |
|  | $83_{227}$ | E-G- | 1246 | DPKMLELMRLYITIH | 1 | 63 | 1 | 40 |
|  | $83_{260}$ | E-G- | 1247 | ALSDPYLSFAAALNG | 1 | 130 | 1 | 70 |
|  | $83_{266}$ | E-G- | 1248 | LSFAAALNGLAGPLH | 1 | 103 | 0 | — |
|  | $83_{278}$ | E-G- | 1249 | PLHGLANQEVLLWIK | 0 | — | 0 | — |
|  | $83_{285}$ | E-G- | 1250 | QEVLLWIKSVMEETG | 0 | — | 0 | — |
|  | $83_{306}$ | E-G- | 1251 | QLKEYVWKTLKSGKV | 1 | 90 | 1 | 40 |
|  | $83_{349}$ | E-G- | 1252 | EDPLFQLVSKLYEVV | 1 | 160 | 0 | — |
|  | $83_{355}$ | E-G- | 1253 | LVSKLYEVVPGILTE | 1 | 207 | 0 | — |
|  | $83_{384}$ | E-G- | 1254 | SGVLLNHFGLVEARY | 1 | 140 | 0 | — |
|  | $83_{400}$ | E-G- | 1255 | TVLFGVSRSMGIGSQ | 1 | 123 | 0 | — |
|  | $83_{412}$ | E-G- | 1256 | GSQLIWDRALGLPLE | 1 | 37 | 1 | 57 |
| 84 | $84_{10}$ | E-G- | 1257 | GPVTILNWSFVRNDQ | 1 | 47 | 0 | — |
|  | $84_{25}$ | E-G- | 1258 | PRFETCYQIALAIKK | 0 | — | 0 | — |
|  | $84_{48}$ | E-G- | 1259 | GIQVIQIDEAALREG | 0 | — | 0 | — |
|  | $84_{69}$ | E-G- | 1260 | EHAFYLDWAVHSFRI | 1 | 53 | 1 | 303 |
|  | $84_{103}$ | E-G- | 1261 | FNDIIHSIINMDADV | 1 | 50 | 0 | — |
|  | $84_{125}$ | E-G- | 1262 | SDEKLLSVFREGVTY | 0 | — | 0 | — |
|  | $84_{165}$ | E-G- | 1263 | VNKMLAVLDTNILWV | 1 | 47 | 0 | — |
|  | $84_{187}$ | E-G- | 1264 | TRKYAEVMPALTNMV | 0 | — | 0 | — |
|  | $84_{195}$ | E-G- | 1265 | PALTNMVTAAKLIRT | 0 | — | 0 | — |
|  | $84_{201}$ | E-G- | 1266 | VTAAKLIRTQLASTK | 0 | — | 0 | — |
| 85 | $85_{10}$ | E-G- | 1267 | GRGIKDEGLVVAPGQ | 0 | — | 0 | — |
|  | $85_{29}$ | E-G- | 1268 | LTVGNIIAGDRFSMA | 0 | — | 0 | — |
|  | $85_{38}$ | E-G- | 1269 | DRFSMAYDRTPEEIL | 0 | — | 0 | — |
|  | $85_{44}$ | E-G- | 1270 | YDRTPEEILAIVYGT | 0 | — | 0 | — |
|  | $85_{50}$ | E-G- | 1271 | EILAIVYGTGNPAQA | 0 | — | 0 | — |
| 86 | $86_{12}$ | E-G- | 1272 | TREENVYMAKLAEQA | 0 | — | 0 | — |
|  | $86_{29}$ | E-G- | 1273 | YEEMVEFMEKVAKTA | 0 | — | 0 | — |
|  | $86_{51}$ | E-G- | 1274 | EERNLLSVAYKNVIG | 0 | — | 0 | — |
|  | $86_{59}$ | E-G- | 1275 | AYKNVIGARRASWRI | 0 | — | 0 | — |
|  | $86_{67}$ | E-G- | 1276 | RRASWRIISSIEQKE | 0 | — | 0 | — |
|  | $86_{86}$ | E-G- | 1277 | NEAYVASIKEYRTRI | 0 | — | 0 | — |
|  | $86_{105}$ | E-G- | 1278 | SKICDGILKLLDSHL | 0 | — | 0 | — |
|  | $86_{111}$ | E-G- | 1279 | ILKLLDSHLVPSATA | 0 | — | 0 | — |
|  | $86_{126}$ | E-G- | 1280 | AESKVFYLKMKGDYH | 0 | — | 0 | — |
|  | $86_{137}$ | E-G- | 1281 | GDYHRYLAEFKAGAE | 0 | — | 0 | — |
|  | $86_{158}$ | E-G- | 1282 | NTLVAYKSAQDIALA | 0 | — | 0 | — |
|  | $86_{174}$ | E-G- | 1283 | LPTTHPIRLGLALNF | 0 | — | 0 | — |
|  | $86_{180}$ | E-G- | 1284 | IRLGLALNFSVFYYE | 0 | — | 0 | — |
|  | $86_{186}$ | E-G- | 1285 | LNFSVFYYEILNSPD | 0 | — | 0 | — |
|  | $86_{225}$ | E-G- | 1286 | YKDSTLIMQLLRDNL | 0 | — | 0 | — |
|  | $86_{231}$ | E-G- | 1287 | IMQLLRDNLTLWTSD | 0 | — | 1 | 73 |
| 87 | $87_8$ | E-G- | 1288 | GSRALPFLLQLTKQP | 0 | — | 0 | — |
|  | $87_{51}$ | E-G- | 1289 | VKVYVVYYSMYGHVG | 0 | — | 0 | — |

TABLE 4-continued

Panel of 822 peptides predicted from 93 novel Timothy Grass (TG) proteins tested for T cell recognition in TG allergic patients.

| Antigen | Peptide | Antibody reactvity IgE/IgG | SEQ ID NO | Sequence | Total response IL-5 Events | SFC | Total response IFNg Events | SFC |
|---|---|---|---|---|---|---|---|---|
| | $87_{80}$ | E-G- | 1290 | GVEVKVWQVPEILSE | 0 | — | 0 | — |
| | $87_{119}$ | E-G- | 1291 | ADGILFGFPTRFGMM | 0 | — | 0 | — |
| | $87_{234}$ | E-G- | 1292 | FHQGKYFAGIAKKLK | 0 | — | 0 | — |
| 88 | $88_2$ | E-G- | 1293 | DVYPTVCLPMCVCVL | 0 | — | 0 | — |
| 89 | $89_{21}$ | E-G- | 1294 | EPAYFATAESVRDHL | 1 | 37 | 0 | — |
| | $89_{53}$ | E-G- | 1295 | QTYYLSMEYLQGRAL | 1 | 37 | 0 | — |
| | $89_{70}$ | E-G- | 1296 | AVGNLGITGAYAEAV | 0 | — | 0 | — |
| | $89_{81}$ | E-G- | 1297 | AEAVKKFGYELEALA | 1 | 33 | 0 | — |
| | $89_{110}$ | E-G- | 1298 | RLAACFLDSMATLNL | 0 | — | 0 | — |
| | $89_{131}$ | E-G- | 1299 | LRYRYGLFKQRIAKE | 0 | — | 1 | 663 |
| | $89_{158}$ | E-G- | 1300 | FSPWEIVRHDVVYPV | 0 | — | 0 | — |
| | $89_{169}$ | E-G- | 1301 | VYPVRFFGHVEILPD | 0 | — | 0 | — |
| | $89_{191}$ | E-G- | 1302 | GEVLNALAYDVPIPG | 2 | 288 | 1 | 1247 |
| | $89_{203}$ | E-G- | 1303 | IPGYKTKNAISLRLW | 0 | — | 0 | — |
| | $89_{223}$ | E-G- | 1304 | AEDFNLFQFNDGQYE | 0 | — | 0 | — |
| | $89_{261}$ | E-G- | 1305 | EGKLLRLKQQFFLCS | 0 | — | 0 | — |
| | $89_{267}$ | E-G- | 1306 | LKQQFFLCSASLQDI | 0 | — | 0 | — |
| | $89_{313}$ | E-G- | 1307 | PTLAIPELMRLLMDE | 0 | — | 0 | — |
| | $89_{360}$ | E-G- | 1308 | QSVMRKLLPRQMEII | 0 | — | 0 | — |
| | $89_{375}$ | E-G- | 1309 | EEIDKRFREMVISTR | 0 | — | 0 | — |
| | $89_{406}$ | E-G- | 1310 | PQKPVVRMANLCVVS | 0 | — | 0 | — |
| | $89_{434}$ | E-G- | 1311 | ILKEELFADYVSIWP | 0 | — | 0 | — |
| | $89_{460}$ | E-G- | 1312 | PRRWLRFCNPELSEI | 1 | 240 | 1 | 153 |
| | $89_{501}$ | E-G- | 1313 | EKLHAEWAAAKLASK | 0 | — | 0 | — |
| | $89_{540}$ | E-G- | 1314 | IKRIHEYKRQLMNIL | 0 | — | 2 | 45 |
| | $89_{546}$ | E-G- | 1315 | YKRQLMNILGAVYRY | 2 | 187 | 1 | 43 |
| | $89_{554}$ | E-G- | 1316 | LGAVYRYKKLKEMSA | 3 | 54 | 1 | 43 |
| | $89_{583}$ | E-G- | 1317 | GKAFATYTNAKRIVK | 2 | 68 | 0 | — |
| | $89_{593}$ | E-G- | 1318 | KRIVKLVNDVGAVVN | 1 | 77 | 2 | 195 |
| | $89_{612}$ | E-G- | 1319 | VNKYLKVVFIPNYNV | 0 | — | 1 | 213 |
| | $89_{619}$ | E-G- | 1320 | VFIPNYNVSVAEVLI | 2 | 28 | 6 | 259 |
| | $89_{681}$ | E-G- | 1321 | EDNFFLFGAKADQVA | 2 | 35 | 2 | 202 |
| | $89_{723}$ | E-G- | 1322 | TFGTYDYTPLLDSLE | 0 | — | 0 | — |
| | $89_{748}$ | E-G- | 1323 | FLVGYDFPSYIDAQA | 0 | — | 0 | — |
| | $89_{772}$ | E-G- | 1324 | KRWIKMSILNTAGSG | 1 | 107 | 3 | 136 |
| | $89_{796}$ | E-G- | 1325 | QYAKEIWGITANPVP | 2 | 105 | 3 | 99 |
| 90 | $90_{33}$ | E-G- | 1326 | KTLAVALGGARPLAT | 0 | — | 1 | 30 |
| | $90_{45}$ | E-G- | 1327 | LATRGVATFTLPDLP | 0 | — | 2 | 30 |
| | $90_{56}$ | E-G- | 1328 | PDLPYDYGALEPAIS | 2 | 37 | 1 | 67 |
| | $90_{82}$ | E-G- | 1329 | HATYVANYNKALEQL | 0 | — | 1 | 57 |
| | $90_{103}$ | E-G- | 1330 | GDASAVVQLQGAIKF | 0 | — | 0 | — |
| | $90_{198}$ | E-G- | 1331 | DPLVTKGANLIPLLG | 0 | — | 0 | 87 |
| | $90_{205}$ | E-G- | 1332 | ANLIPLLGIDVWEHA | 0 | — | 1 | 113 |
| | $90_{218}$ | E-G- | 1333 | HAYYLQYKNVRPDYL | 1 | 80 | 2 | 48 |
| | $90_{229}$ | E-G- | 1334 | PDYLTNIWKVVNWKY | 1 | 30 | 1 | 70 |
| 91 | $91_{35}$ | E-G- | 1335 | APSGRIVMELYADVV | 3 | 246 | 2 | 82 |
| | $91_{41}$ | E-G- | 1336 | VMELYADVVPKTAEN | 0 | — | 2 | 70 |
| | $91_{74}$ | E-G- | 1337 | HYKGSSFHRVIPGFM | 3 | 208 | 1 | 207 |
| | $91_{104}$ | E-G- | 1338 | SIYGAKFADENFIKK | 0 | — | 1 | 60 |
| | $91_{135}$ | E-G- | 1339 | NGSQFFLCTAKTAWL | 1 | 530 | 2 | 130 |
| 92 | $92_1$ | E-G- | 1340 | SQVHIRRPGGAGRDG | 0 | — | 1 | 113 |
| | $92_7$ | E-G- | 1341 | RPGGAGRDGGQLRIP | 0 | — | 1 | 130 |
| | $92_{13}$ | E-G- | 1342 | RDGGQLRIPSLLHGG | 0 | — | 1 | 97 |
| | $92_{27}$ | E-G- | 1343 | GHGCAQPAMERRKHI | 0 | — | 2 | 233 |
| | $92_{38}$ | E-G- | 1344 | RKHIEWNCDVCRHGD | 0 | — | 1 | 83 |
| 93 | $93_1$ | E-G- | 1345 | WTTVMRASCGHHRFR | 0 | — | 1 | 87 |
| | $93_{13}$ | E-G- | 1346 | RFRDCVISSLADFKL | 0 | — | 2 | 47 |
| | $93_{19}$ | E-G- | 1347 | ISSLADFKLFPVLQH | 0 | — | 1 | 67 |
| | $93_{29}$ | E-G- | 1348 | PVLQHIISIAVLAIF | 0 | — | 1 | 140 |
| | $93_{35}$ | E-G- | 1349 | ISIAVLAIFIGLLMI | 0 | — | 2 | 123 |

TABLE 5

Antibody reactivity and IL-5 production of NTGAs and NTGA-derived peptides.

| IgE | IgG | Antigens tested | Antigens positive | % positive | Peptides tested | Peptides positive | % positive | Total SFC |
|---|---|---|---|---|---|---|---|---|
| − | + | 24 | 14 | 58.3 | 173 | 46 | 26.6 | 6,154 |
| + | − | 13 | 9 | 69.2 | 118 | 33 | 28.0 | 1,796 |
| + | + | 16 | 12 | 75.0 | 187 | 93 | 49.7 | 7,229 |
| − | − | 30 | 17 | 56.7 | 256 | 68 | 26.6 | 7,628 |
| n.d. | n.d. | 10 | 2 | 20.0 | 88 | 10 | 11.4 | 1,053 |
|  |  | 93 | 54 | 64.8 | 822 | 250 | 28.4 | 23,860 |

TABLE 6

Epitopes tested positive for T Cell Recognition

| Antigen | Peptide | Antibody reactivity IgE/IgG | SEQ ID NO: | Sequence | Total response IL-5 Events | SFC | Total response IFNq Events | SFC |
|---|---|---|---|---|---|---|---|---|
| 1 | 1$_{161}$ | E+G+ | 632 | GNKQLVLPVPAFNVI | 0 | — | 1 | 190 |
|  | 1$_{304}$ | E+G+ | 636 | VYKSFVSEYPIVSIE | 1 | 40 | 0 | — |
|  | 1$_{342}$ | E+G+ | 637 | IVGDDLLVTNPTRVA | 0 | 0 | 1 | 193 |
|  | 1$_{365}$ | E+G+ | 638 | NALLLKVNQIGSVTE | 1 | 40 | 1 | 170 |
|  | 1$_{444}$ | E+G+ | 641 | LGAAAVYAGLKFRAP | 0 | — | 1 | 153 |
| 2 | 2$_{1}$ | E+G+ | 696 | AEFEGVFLDFARQQA | 2 | 58 | 0 | — |
|  | 2$_{20}$ | E+G+ | 697 | VDKLFKLAEAAKLKE | 2 | 88 | 2 | 247 |
|  | 2$_{49}$ | E+G+ | 698 | ENRSVLHVALRAPRD | 2 | 63 | 1 | 27 |
|  | 2$_{116}$ | E+G+ | 699 | FLGPLFVHTALQTDP | 1 | 63 | 0 | — |
|  | 2$_{139}$ | E+G+ | 700 | RQLRFLANVDPVDVA | 1 | 20 | 1 | 20 |
|  | 2$_{168}$ | E+G+ | 701 | VVSKTFTTAETMLNA | 0 | — | 1 | 97 |
|  | 2$_{198}$ | E+G+ | 703 | VSKHMIAVSTNLKLV | 2 | 80 | 1 | 20 |
|  | 2$_{232}$ | E+G+ | 704 | RYSVCSAVGVLPLSL | 3 | 83 | 3 | 238 |
|  | 2$_{238}$ | E+G+ | 705 | AVGVLPLSLQYGFPI | 3 | 71 | 4 | 121 |
|  | 2$_{244}$ | E+G+ | 706 | LSLQYGFPIVQRFLE | 1 | 127 | 1 | 50 |
|  | 2$_{250}$ | E+G+ | 707 | FPIVQRFLEGASSID | 2 | 92 | 1 | 90 |
|  | 2$_{266}$ | E+G+ | 708 | HFRTASFEKNIPVLL | 1 | 33 | 0 | — |
|  | 2$_{278}$ | E+G+ | 709 | VLLGLLSVWNVSFLG | 2 | 50 | 0 | — |
|  | 2$_{284}$ | E+G+ | 710 | SVWNVSFLGYPARAI | 1 | 100 | 1 | 53 |
|  | 2$_{295}$ | E+G+ | 711 | ARAILPYSQALEKLA | 1 | 120 | 1 | 27 |
|  | 2$_{346}$ | E+G+ | 712 | NGQHSFYQLIHQGRV | 1 | 27 | 2 | 95 |
|  | 2$_{363}$ | E+G+ | 713 | CDFIGVIKSQQPVYL | 2 | 98 | 2 | 238 |
|  | 2$_{387}$ | E+G+ | 714 | ELMSNFFAQPDALAY | 2 | 102 | 3 | 99 |
|  | 2$_{421}$ | E+G+ | 715 | KTFKGNRPSLSFLLS | 2 | 42 | 5 | 363 |
|  | 2$_{428}$ | E+G+ | 716 | PSLSFLLSSLSAYEI | 1 | 67 | 1 | 53 |
|  | 2$_{439}$ | E+G+ | 717 | AYEIGQLLAIYEHRI | 1 | 40 | 0 | — |
|  | 2$_{445}$ | E+G+ | 718 | LLAIYEHRIAVQGFI | 1 | 77 | 2 | 42 |
|  | 2$_{456}$ | E+G+ | 719 | QGFIWGINSFDQWGV | 1 | 113 | 0 | — |
|  | 2$_{493}$ | E+G+ | 720 | PVEGFNPSSASLLAR | 1 | 143 | 1 | 47 |
|  | 2$_{499}$ | E+G+ | 721 | PSSASLLARYLAVEP | 1 | 127 | 0 | — |
| 3 | 3$_{50}$ | E+G+ | 734 | LKDGSTYSFRFSFIV | 1 | 20 | 0 | — |
| 4 | 4$_{6}$ | E+G+ | 777 | MKTIFDFESIKKLLA | 0 | — | 1 | 43 |
|  | 4$_{12}$ | E+G+ | 778 | FESIKKLLASPKFSF | 1 | 47 | 2 | 245 |
|  | 4$_{41}$ | E+G+ | 779 | RMFVDELGASESSLL | 1 | 47 | 1 | 30 |
|  | 4$_{70}$ | E+G+ | 780 | PNLTYAKELVERMGL | 0 | — | 1 | 33 |
|  | 4$_{106}$ | E+G+ | 781 | RNMVLGKRFFVTPSD | 1 | 33 | 1 | 27 |
|  | 4$_{129}$ | E+G+ | 784 | AVQSIPYFASGLKGV | 0 | — | 1 | 37 |
|  | 4$_{203}$ | E+G+ | 786 | GIWAVLAWLSIIAYK | 0 | — | 1 | 107 |
|  | 4$_{260}$ | E+G+ | 789 | KELMANLVKMQSALS | 1 | 327 | 1 | 97 |
|  | 4$_{266}$ | E+G+ | 790 | LVKMQSALSDVNKLI | 2 | 35 | 0 | — |
| 5 | 5$_{27}$ | E+G+ | 813 | TVSDEYLAAVAKARR | 0 | — | 1 | 73 |
| 6 | 6$_{1}$ | E+G+ | 827 | TLLFPHTQISLPSVR | 2 | 32 | 0 | — |
|  | 6$_{44}$ | E+G+ | 829 | DNEKSGFISLVSRYL | 2 | 38 | 0 | — |
|  | 6$_{92}$ | E+G+ | 831 | EATKALLNKLAVLKL | 1 | 33 | 0 | — |
|  | 6$_{123}$ | E+G+ | 832 | IEVRNGFTFLDLIVL | 1 | 27 | 0 | — |
|  | 6$_{131}$ | E+G+ | 833 | FLDLIVLQIESLNKK | 1 | 33 | 0 | — |
|  | 6$_{142}$ | E+G+ | 834 | LNKKYGSNVPLLLMN | 1 | 353 | 0 | — |
|  | 6$_{149}$ | E+G+ | 835 | NVPLLLMNSFNTHED | 1 | 153 | 0 | — |
|  | 6$_{165}$ | E+G+ | 836 | LKIVEKYANSSIDIH | 3 | 196 | 3 | 654 |
|  | 6$_{175}$ | E+G+ | 837 | SIDIHTFNQSQYPRV | 2 | 113 | 1 | 243 |
|  | 6$_{224}$ | E+G+ | 838 | GKLDLLLSQGKEYVF | 1 | 87 | 2 | 65 |

TABLE 6-continued

Epitopes tested positive for T Cell Recognition

| Antigen | Peptide | Antibody reactvity IgE/IgG | SEQ ID NO: | Sequence | Total response IL-5 Events | SFC | Total response IFNq Events | SFC |
|---|---|---|---|---|---|---|---|---|
| | 6$_{233}$ | E+G+ | 839 | GKEYVFIANSDNLGA | 2 | 115 | 0 | — |
| | 6$_{242}$ | E+G+ | 840 | SDNLGAIVDMKILNH | 2 | 28 | 1 | 30 |
| | 6$_{248}$ | E+G+ | 841 | IVDMKILNHLIHKQN | 3 | 101 | 2 | 160 |
| | 6$_{288}$ | E+G+ | 843 | VQLLEIAQVPDAHVD | 1 | 73 | 0 | — |
| | 6$_{304}$ | E+G+ | 844 | FKSIEKFKIFNTNNL | 1 | 30 | 1 | 357 |
| | 6$_{310}$ | E+G+ | 845 | FKIFNTNNLWVNLKA | 2 | 60 | 0 | — |
| | 6$_{316}$ | E+G+ | 846 | NNLWVNLKAIKRLVE | 3 | 517 | 2 | 823 |
| | 6$_{325}$ | E+G+ | 847 | IKRLVEADALKMEII | 2 | 103 | 1 | 397 |
| | 6$_{348}$ | E+G+ | 848 | VKVLQLETAAGAAIR | 3 | 60 | 1 | 50 |
| | 6$_{359}$ | E+G+ | 849 | AAIRFFDHAIGINVP | 4 | 105 | 4 | 344 |
| | 6$_{369}$ | E+G+ | 850 | GINVPRSRFLPVKAT | 1 | 23 | 0 | — |
| | 6$_{376}$ | E+G+ | 851 | RFLPVKATSDLQLVQ | 2 | 60 | 1 | 83 |
| | 6$_{383}$ | E+G+ | 852 | TSDLQLVQSDLYTLV | 1 | 40 | 1 | 87 |
| | 6$_{389}$ | E+G+ | 853 | VQSDLYTLVDGFVTR | 2 | 82 | 1 | 60 |
| | 6$_{418}$ | E+G+ | 854 | GPEFKKVGSFLGRFK | 2 | 182 | 2 | 147 |
| | 6$_{429}$ | E+G+ | 855 | GRFKSIPSIVELDSL | 3 | 247 | 0 | — |
| 7 | 7$_{31}$ | E+G+ | 860 | GTIRNIINGTVFREP | 3 | 109 | 2 | 523 |
| | 7$_{101}$ | E+G+ | 861 | VFNFTGAGGVALAMY | 3 | 118 | 3 | 968 |
| | 7$_{121}$ | E+G+ | 862 | IQGFAEASMAIAYEK | 2 | 33 | 1 | 50 |
| | 7$_{127}$ | E+G+ | 863 | ASMAIAYEKKWPLYL | 2 | 52 | 1 | 80 |
| | 7$_{134}$ | E+G+ | 864 | EKKWPLYLSTKNTIL | 1 | 63 | 1 | 117 |
| | 7$_{153}$ | E+G+ | 865 | GRFKDIFQAVYEADW | 1 | 57 | 2 | 63 |
| | 7$_{177}$ | E+G+ | 866 | WYEHRLIDDMVAYAL | 1 | 43 | 0 | — |
| | 7$_{208}$ | E+G+ | 867 | VQSDFLAQGFGSLGL | 2 | 35 | 1 | 80 |
| | 7$_{260}$ | E+G+ | 868 | NSIASIFAWTRGLAH | 0 | — | 1 | 63 |
| | 7$_{280}$ | E+G+ | 869 | DNARLLDFTQKLEDA | 2 | 37 | 0 | — |
| | 7$_{304}$ | E+G+ | 870 | MTKDLALLVHGSSKV | 1 | 40 | 2 | 128 |
| | 7$_{324}$ | E+G+ | 871 | LNTEEFIDAVAAELQ | 3 | 60 | 3 | 92 |
| 8 | 8$_{3}$ | E+G+ | 1115 | TIVASGIENMKIFTR | 0 | — | 1 | 293 |
| 9 | 9$_{56}$ | E+G+ | 892 | TDTIVYCAGRTFFFR | 0 | — | 1 | 180 |
| | 9$_{64}$ | E+G+ | 893 | GRTFFFRRLDAPLDA | 0 | — | 1 | 383 |
| | 9$_{152}$ | E+G+ | 894 | KSLVRAFMWDSGSTV | 0 | — | 0 | — |
| | 9$_{175}$ | E+G+ | 895 | RVLSCDFKPTRPFRI | 0 | — | 1 | 97 |
| | 9$_{355}$ | E+G+ | 898 | VSSLTYFPQSNPRTM | 1 | 23 | 0 | — |
| | 9$_{397}$ | E+G+ | 900 | TQIKCFVAAEEELIT | 1 | 20 | 0 | — |
| | 9$_{441}$ | E+G+ | 901 | NALNIAVQQPEFALI | 1 | 60 | 0 | — |
| | 9$_{450}$ | E+G+ | 902 | PEFALITTDSAIVLL | 1 | 33 | 0 | — |
| | 9$_{499}$ | E+G+ | 905 | KLRIYSISGDTLTEE | 0 | — | 1 | 53 |
| | 9$_{526}$ | E+G+ | 906 | IHYSPDVSMFASADA | 1 | 30 | 0 | — |
| | 9$_{554}$ | E+G+ | 907 | IKLKNMLFHTARINC | 1 | 33 | 1 | 20 |
| 10 | 10$_{10}$ | E+G+ | 974 | GRYFSKDAVQIITKM | 1 | 43 | 1 | 170 |
| | 10$_{16}$ | E+G+ | 975 | DAVQIITKMAAANGV | 1 | 160 | 1 | 83 |
| | 10$_{29}$ | E+G+ | 976 | GVRRVWVGQDSLLST | 0 | — | 2 | 30 |
| | 10$_{39}$ | E+G+ | 977 | SLLSTPAVSAIIRER | 1 | 37 | 2 | 30 |
| | 10$_{45}$ | E+G+ | 978 | AVSAIIRERIAADGS | 1 | 60 | 1 | 47 |
| 11 | 11$_{58}$ | E+G+ | 992 | SVGFVETLENDLAQL | 1 | 30 | 1 | 47 |
| | 11$_{111}$ | E+G+ | 993 | LGEAPYKFKSALEAV | 1 | 53 | 2 | 488 |
| | 11$_{117}$ | E+G+ | 994 | KFKSALEAVKTLRAE | 1 | 43 | 1 | 73 |
| | 11$_{137}$ | E+G+ | 995 | QYLPAFVIVDESGKS | 1 | 23 | 0 | — |
| | 11$_{161}$ | E+G+ | 996 | VVTFNFRADRMVMLA | 2 | 50 | 0 | — |
| | 11$_{168}$ | E+G+ | 997 | ADRMVMLAKALEFAD | 1 | 40 | 0 | — |
| | 11$_{206}$ | E+G+ | 1000 | LKLPNKFLVSPPLIE | 1 | 30 | 0 | — |
| 12 | 12$_{5}$ | E+G+ | 1013 | YKLLCSSFPVITYHQ | 2 | 60 | 0 | — |
| | 12$_{12}$ | E+G+ | 1014 | FPVITYHQGRNGNLS | 1 | 103 | 0 | — |
| | 12$_{21}$ | E+G+ | 1015 | RNGNLSALACPLNQK | 1 | 20 | 0 | — |
| 14 | 14$_{1}$ | E+G+ | 1087 | LLGYLLWVVAIRRPR | 1 | 110 | 0 | — |
| 16 | 16$_{3}$ | E-G- | 1350 | DEKLLSVFREGVVYG | 0 | — | 1 | 113 |
| | 16$_{21}$ | E-G- | 1351 | GPGVYDIHSPRIPSK | 0 | — | 2 | 80 |
| | 16$_{36}$ | E-G- | 1352 | EEIADDFALFRGTRP | 0 | — | 2 | 107 |
| | 16$_{42}$ | E-G- | 1353 | FALFRGTRPPRRPKK | 0 | — | 1 | 97 |
| | 16$_{68}$ | E-G- | 1354 | LCPGFCLADVTPETY | 0 | — | 2 | 45 |
| 17 | 17$_{2}$ | E+G+ | 1170 | VCTRLSPFCCLYCIL | 2 | 52 | 0 | — |
| | 17$_{13}$ | E+G+ | 1171 | YCILCCWYSMRLVTV | 1 | 63 | 0 | — |

TABLE 6-continued

Epitopes tested positive for T Cell Recognition

| Antigen | Peptide | Antibody reactvity IgE/IgG | SEQ ID NO: | Sequence | Total response IL-5 | | Total response IFNq | |
|---|---|---|---|---|---|---|---|---|
| | | | | | Events | SFC | Events | SFC |
| 20 | $20_{294}$ | E+G− | 810 | DKPVVAFIAGLTAPP | 1 | 23 | 0 | — |
| | $20_{329}$ | E+G− | 811 | KIKALREAGVTVVES | 1 | 23 | 0 | — |
| 22 | $22_{131}$ | E+G− | 874 | QCAIIMFDVTSRLTY | 1 | 27 | 0 | — |
| | $22_{206}$ | E+G− | 877 | KPFLYLARKLAGDAN | 2 | 88 | 1 | 603 |
| | $22_{219}$ | E+G− | 878 | ANIHFVEAVALKPPE | 0 | — | 1 | 63 |
| | $22_{245}$ | E+G− | 879 | EAELAAAAAQPLPDD | 1 | 20 | 0 | — |
| 23 | $23_{1}$ | E+G− | 936 | RTSSWGSGASLKIDR | 1 | 27 | 0 | — |
| | $23_{10}$ | E+G− | 937 | SLKIDRRELVTTRIY | 2 | 35 | 0 | — |
| 24 | $24_{21}$ | E+G− | 938 | RFLHAAVAMATKRSV | 0 | — | 1 | 150 |
| | $24_{44}$ | E+G− | 939 | KGKKVFLRADLNVPL | 1 | 30 | 3 | 234 |
| | $24_{76}$ | E+G− | 941 | TIKFLLEKGAKVILA | 2 | 47 | 0 | — |
| | $24_{82}$ | E+G− | 942 | EKGAKVILASHLGRP | 1 | 63 | 0 | — |
| | $24_{109}$ | E+G− | 943 | VPRLSELLGVEVVMA | 2 | 70 | 2 | 118 |
| | $24_{141}$ | E+G− | 944 | GGVLLLENVRFYKEE | 2 | 45 | 1 | 23 |
| | $24_{160}$ | E+G− | 945 | PEFAKKLASVADLYV | 2 | 45 | 0 | — |
| | $24_{193}$ | E+G− | 946 | KFLRPSVAGFLMQKE | 3 | 38 | 1 | 177 |
| | $24_{199}$ | E+G− | 947 | VAGFLMQKELDYLVG | 1 | 90 | 0 | — |
| | $24_{206}$ | E+G− | 948 | KELDYLVGAVANPKK | 1 | 37 | 1 | 143 |
| | $24_{234}$ | E+G− | 949 | KIGVIESLLAKVDIL | 1 | 57 | 0 | — |
| | $24_{253}$ | E+G− | 950 | GMIFTFYKAQGKAVG | 0 | — | 2 | 397 |
| | $24_{272}$ | E+G− | 951 | EEDKLELATSLIETA | 2 | 52 | 1 | 23 |
| | $24_{290}$ | E+G− | 952 | GVSLLLPTDVVVADK | 1 | 90 | 0 | — |
| 25 | $25_{2}$ | E+G− | 953 | SAPALRILRSFPSHS | 1 | 97 | 1 | 143 |
| 26 | $26_{138}$ | E+G− | 958 | KVINDRFGIVEGLMT | 0 | — | 1 | 37 |
| 27 | $27_{76}$ | E+G− | 986 | LQHISGVILFEETLY | 1 | 53 | 0 | — |
| | $27_{144}$ | E+G− | 987 | YEAGARFAKWRAVLK | 1 | 33 | 0 | — |
| | $27_{175}$ | E+G− | 988 | GLARYAIICQENGLV | 2 | 33 | 1 | 140 |
| | $27_{206}$ | E+G− | 989 | RCAYVTEVVLAACYK | 1 | 27 | 0 | — |
| | $27_{223}$ | E+G− | 990 | NDQHVLLEGSLLKPN | 1 | 27 | 0 | — |
| | $27_{300}$ | E+G− | 991 | WFLSFSFGRALQQST | 1 | 23 | 0 | — |
| 28 | $28_{2}$ | E+G− | 1016 | IPPAPHLKRWNRVVD | 1 | 127 | 0 | — |
| | $28_{29}$ | E+G− | 1019 | GAPFTGSGYRIAPYS | 1 | 107 | 0 | — |
| | $28_{36}$ | E+G− | 1020 | GYRIAPYSSILLKAT | 0 | — | 2 | 477 |
| 29 | $29_{2}$ | E+G− | 1072 | SFRFFLAHSSIHPST | 2 | 83 | 0 | — |
| | $29_{106}$ | E+G− | 1074 | TEKGIELILSTEIVK | 1 | 50 | 1 | 247 |
| | $29_{124}$ | E+G− | 1075 | ASKTLTSAAGATFTY | 1 | 30 | 0 | — |
| | $29_{199}$ | E+G− | 1078 | LELSAALKLNNFDVT | 1 | 133 | 0 | — |
| 30 | $30_{285}$ | E+G− | 1099 | VFNDDIQGTASVVLA | 1 | 67 | 0 | — |
| 32 | $32_{41}$ | E−G+ | 755 | IEIDSLFEGIDFYST | 0 | — | 1 | 27 |
| | $32_{50}$ | E−G+ | 756 | IDFYSTITRARFEEL | 1 | 20 | 0 | — |
| | $32_{126}$ | E−G+ | 758 | EAVAYGAAVQAAILS | 0 | — | 1 | 30 |
| | $32_{147}$ | E−G+ | 759 | VQDLLLLDVTPLSLG | 0 | — | 1 | 47 |
| 34 | $34_{140}$ | E−G+ | 764 | KPIHFVGTSTFSEY | 1 | 40 | 0 | — |
| | $34_{349}$ | E−G+ | 770 | KFITHSVTFSEINKA | 1 | 50 | 1 | 103 |
| | $34_{355}$ | E−G+ | 771 | VTFSEINKAFDLMAK | 0 | — | 1 | 103 |
| 35 | $35_{1}$ | E−G+ | 772 | ALRWNLQMGHSVLPK | 1 | 47 | 0 | — |
| | $35_{25}$ | E−G+ | 773 | NLDVYDWSIPDDLLA | 1 | 90 | 1 | 67 |
| | $35_{35}$ | E−G+ | 774 | DDLLAKFSEIKQTRL | 1 | 30 | 0 | — |
| 39 | $39_{111}$ | E−G+ | 930 | GESSEFVGDKVAYAL | 0 | — | 1 | 30 |
| | $39_{118}$ | E−G+ | 931 | GDKVAYALAQGLKVI | 1 | 67 | 1 | 73 |
| 40 | $40_{2}$ | E−G+ | 963 | VWQHDRVEIIANDQG | 1 | 40 | 0 | — |
| | $40_{8}$ | E−G+ | 964 | VEIIANDQGNRTTPS | 1 | 27 | 0 | — |
| 41 | $41_{1}$ | E−G+ | 968 | SSTRGWCSRRAGRG | 0 | — | 0 | — |
| 42 | $42_{69}$ | E−G+ | 972 | GVIAGLNVLRIINEP | 0 | — | 1 | 33 |

TABLE 6-continued

Epitopes tested positive for T Cell Recognition

| Antigen | Peptide | Antibody reactvity IgE/IgG | SEQ ID NO: | Sequence | Total response IL-5 Events | SFC | Total response IFNq Events | SFC |
|---|---|---|---|---|---|---|---|---|
| 43 | $43_{120}$ | E-G+ | 1004 | YVVPWGFYKAVMHVK | 1 | 20 | 0 | — |
|  | $43_{191}$ | E-G+ | 1007 | FAWSLLDNFEWRMGF | 1 | 27 | 0 | — |
| 46 | $46_{3}$ | E-G+ | 1042 | RGLLRRARGGPHHRR | 1 | 40 | 0 | — |
|  | $46_{19}$ | E-G+ | 1043 | RGAHRRVPLRPLRHR | 0 | — | 1 | 60 |
|  | $46_{40}$ | E-G+ | 1044 | EGRRAKLRSAGEVEI | 1 | 177 | 0 | — |
|  | $46_{50}$ | E-G+ | 1045 | GEVEIQFRRVKCKYP | 4 | 60 | 0 | — |
|  | $46_{67}$ | E-G+ | 1046 | TKVTFHVVGVGPLLH | 1 | 70 | 1 | 160 |
| 47 | $47_{41}$ | E-G+ | 1048 | GKFAAERGAFTVVLS | 1 | 30 | 0 | — |
|  | $47_{49}$ | E-G+ | 1049 | AFTVVLSGGTLIDTL | 1 | 43 | 0 | — |
|  | $47_{96}$ | E-G+ | 1050 | DSNYKLAVDGLLSKV | 1 | 53 | 0 | — |
|  | $47_{135}$ | E-G+ | 1051 | TVLKQLVKSGVLAMS | 2 | 22 | 0 | — |
|  | $47_{142}$ | E-G+ | 1052 | KSGVLAMSTATGFPR | 1 | 40 | 0 | — |
| 48 | $48_{269}$ | E-G+ | 1063 | YAVGQKIKAYLEAES | 0 | — | 1 | 297 |
| 49 | $49_{1}$ | E-G+ | 1121 | ELRKTYNLLDAVSRH | 4 | 847 | 1 | 100 |
|  | $49_{18}$ | E-G+ | 1122 | QVYPRSWSAVMLTFD | 2 | 602 | 0 | — |
|  | $49_{26}$ | E-G+ | 1123 | AVMLTFDNAGMWNVR | 3 | 899 | 1 | 503 |
|  | $49_{42}$ | E-G+ | 1124 | NVWERHYLAGEMTLM | 1 | 130 | 0 | — |
|  | $49_{50}$ | E-G+ | 1125 | GEQLYISVISPARSL | 0 | — | 1 | 80 |
| 50 | $50_{44}$ | E-G+ | 1127 | IGNLRLDNTTLIDKD | 1 | 40 | 0 | — |
|  | $50_{88}$ | E-G+ | 1128 | EIPMIQNILSRSQIF | 0 | — | 2 | 158 |
|  | $50_{92}$ | E-G+ | 1129 | SRSQIFDGIPNLMSL | 0 | — | 1 | 87 |
|  | $50_{103}$ | E-G+ | 1130 | DGIPNLMSLDNVVKI | 0 | — | 2 | 158 |
|  | $50_{150}$ | E-G+ | 1132 | EFPVTWVSSPEVALL | 0 | — | 1 | 97 |
|  | $50_{158}$ | E-G+ | 1133 | SPEVALLKSLAGKLR | 1 | 27 | 1 | 87 |
|  | $50_{174}$ | E-G+ | 1135 | STKLIFRFLREDLVE | 1 | 30 | 0 | — |
|  | $50_{196}$ | E-G+ | 1136 | GELLKDLKSIKAFAS | 0 | — | 1 | 43 |
| 51 | $51_{21}$ | E-G+ | 1139 | LLETHLVPSSTAPES | 0 | — | 1 | 47 |
|  | $51_{33}$ | E-G+ | 1140 | PESKVFYLKMKGDYH | 1 | 27 | 1 | 53 |
|  | $51_{67}$ | E-G+ | 1141 | MNSYKAAQDIALADL | 0 | — | 1 | 43 |
| 52 | $52_{1}$ | E-G+ | 1143 | LLGLLAPLASAQLSR | 0 | — | 1 | 33 |
|  | $52_{23}$ | E-G+ | 1144 | PDAEKIVAAVIEKKL | 1 | 20 | 0 | — |
|  | $52_{45}$ | E-G+ | 1145 | AGLLRLLFHDCFANG | 1 | 113 | 1 | 37 |
|  | $52_{60}$ | E-G+ | 1146 | CDASILIDPLSNQSA | 3 | 91 | 5 | 151 |
|  | $52_{229}$ | E-G+ | 1147 | IDSSYFANVLAKKMP | 1 | 50 | 1 | 50 |
|  | $52_{266}$ | E-G+ | 1148 | KPNDFMPTFAKAMEK | 0 | — | 1 | 33 |
|  | $52_{272}$ | E-G+ | 1149 | PTFAKAMEKLSVLKV | 2 | 53 | 2 | 62 |
|  | $52_{309}$ | E-G+ | 1150 | GGSVIRISSANPEDL | 1 | 70 | 2 | 72 |
| 53 | $53_{1}$ | E-G+ | 1152 | WSEIQTLKPNLIGPF | 0 | — | 1 | 103 |
|  | $53_{57}$ | E-G+ | 1155 | AAYLATRGLDVVDAV | 1 | 880 | 1 | 1030 |
|  | $53_{64}$ | E-G+ | 1156 | GLDVVDAVSNALIKS | 1 | 23 | 0 | — |
|  | $53_{84}$ | E-G+ | 1157 | TKQQVFIQSEDPPVL | 3 | 42 | 0 | — |
|  | $53_{96}$ | E-G+ | 1158 | PVLSAFKKFPKFNRV | 1 | 53 | 0 | — |
|  | $53_{103}$ | E-G+ | 1159 | KFPKFNRVFEIEFDI | 1 | 30 | 3 | 499 |
|  | $53_{126}$ | E-G+ | 1160 | VEIKEFANAVKLRRS | 1 | 87 | 1 | 797 |
|  | $53_{135}$ | E-G+ | 1161 | VKLRRSSAAQVDGFY | 3 | 104 | 0 | — |
|  | $53_{170}$ | E-G+ | 1163 | GVLKNEFMSLAFDYW | 1 | 83 | 0 | — |
|  | $53_{202}$ | E-G+ | 1164 | GLVTEFPSTAAAYFR | 1 | 63 | 1 | 153 |
| 54 | $54_{39}$ | E-G+ | 1165 | NIVVNVFNQLDQPLL | 1 | 43 | 0 | — |
|  | $54_{93}$ | E-G+ | 1167 | IGSFFYFPSIGMQRT | 5 | 447 | 4 | 183 |
|  | $54_{116}$ | E-G+ | 1169 | VVSRLLIPVPFDPPA | 1 | 307 | 1 | 133 |
| 55 | $55_{40}$ | E-G- | 687 | IGEIKGFADAVMVSR | 0 | — | 1 | 167 |
|  | $55_{60}$ | E-G- | 690 | VNGFFLTGFNDLVTE | 0 | — | 1 | 903 |
| 56 | $56_{21}$ | E-G- | 725 | KIASFLDPDGWKVVL | 0 | — | 1 | 343 |
| 59 | $59_{75}$ | E-G- | 740 | FLQQAKALLRPDFAV | 0 | — | 1 | 33 |
|  | $59_{81}$ | E-G- | 741 | ALLRPDFAVAAQNCW | 0 | — | 1 | 23 |
|  | $59_{106}$ | E-G- | 743 | ISAEMLVNLQVPWVI | 0 | — | 1 | 37 |
|  | $59_{138}$ | E-G- | 745 | ADKVAYALAQGLKVI | 1 | 47 | 2 | 45 |
|  | $59_{166}$ | E-G- | 746 | TTMEVVAAQTKAIAE | 0 | — | 1 | 23 |
|  | $59_{185}$ | E-G- | 747 | WTNVVLAYEPVPWAIG | 1 | 20 | 0 | — |

TABLE 6-continued

Epitopes tested positive for T Cell Recognition

| Antigen | Peptide | Antibody reactvity IgE/IgG | SEQ ID NO: | Sequence | Total response IL-5 Events | SFC | Total response IFNq Events | SFC |
|---|---|---|---|---|---|---|---|---|
| | $59_{216}$ | E-G- | 748 | LRKWLHANVGPAVAE | 0 | — | 2 | 138 |
| | $59_{266}$ | E-G- | 749 | PEFVDIIKSATVKSS | 0 | — | 1 | 137 |
| 61 | $61_{19}$ | E-G- | 859 | KVSKVLNTYIFLLYL | 1 | 27 | 0 | — |
| 62 | $62_{11}$ | E-G- | 880 | YQPAAMRRLSLILLA | 1 | 63 | 0 | — |
| | $62_{140}$ | E-G- | 885 | CADILAIASRVLVTM | 1 | 43 | 0 | — |
| | $62_{185}$ | E-G- | 886 | NFTVGRIIELFTAKG | 4 | 200 | 6 | 223 |
| | $62_{191}$ | E-G- | 887 | IIELFTAKGFTVQEM | 2 | 298 | 4 | 179 |
| | $62_{200}$ | E-G- | 888 | FTVQEMVALSGAHTL | 0 | — | 1 | 537 |
| | $62_{276}$ | E-G- | 890 | FDNIYSVNIERGLGL | 0 | — | 1 | 73 |
| 63 | $63_{11}$ | E-G- | 980 | ILLLLHGANAALDEP | 0 | — | 1 | 47 |
| | $63_{114}$ | E-G- | 983 | IHGWFAVDFTAAELV | 1 | 120 | 2 | 227 |
| 64 | $64_{111}$ | E-G- | 1011 | KNPLKFDNTYFTELL | 1 | 100 | 1 | 47 |
| 65 | $65_{22}$ | E-G- | 1116 | FSCDSAYQVTYIVRG | 1 | 23 | 1 | 47 |
| | $65_{28}$ | E-G- | 1117 | YQVTYIVRGSGRVQV | 1 | 87 | 1 | 367 |
| | $65_{55}$ | E-G- | 1118 | IEGGSLFIVPRFHVV | 1 | 130 | 1 | 113 |
| 72 | $72_{291}$ | n.d. | 1374 | DAYICAIRRAKSFIY | 1 | 40 | 1 | 77 |
| | $72_{433}$ | n.d. | 1380 | DYLKAQQNRRFMIYV | 1 | 190 | 1 | 33 |
| 73 | $73_{326}$ | n.d. | 1418 | DVLREPHLYTFSFRN | 1 | 77 | 0 | — |
| | $73_{343}$ | n.d. | 1419 | LEVTEVFNFSQDDLL | 1 | 63 | 0 | — |
| | $73_{340}$ | n.d. | 1420 | FNFSQDDLLTEDVMI | 1 | 90 | 0 | — |
| | $73_{660}$ | n.d. | 1431 | SRSFLKHSLLRTQRL | 1 | 73 | 0 | — |
| | $73_{666}$ | n.d. | 1432 | HSLLRTQRLHKFLVC | 1 | 87 | 0 | — |
| | $73_{674}$ | n.d. | 1433 | LHKFLVCSSMIGVMA | 0 | — | 0 | — |
| | $73_{694}$ | n.d. | 1434 | SGNLVMFQMQDHQLI | 1 | 157 | 0 | — |
| | $73_{706}$ | n.d. | 1435 | QLIYPLISPSFLVYS | 1 | 200 | 0 | — |
| | $73_{712}$ | n.d. | 1436 | ISPSFLVYSFFVHDL | 1 | 77 | 0 | — |
| 76 | $76_{11}$ | E-G- | 1172 | NIWADDLAASLSTLE | 0 | — | 1 | 390 |
| | $76_{17}$ | E-G- | 1173 | IAIAFLSVSNNYEYI | 1 | 47 | 0 | — |
| | $76_{40}$ | E-G- | 1176 | TSCSLMHTAVDLVNE | 1 | 160 | 0 | — |
| | $76_{55}$ | E-G- | 1177 | TKLDSEIKSWLAFAA | 1 | 200 | 1 | 323 |
| | $76_{85}$ | E-G- | 1180 | LKDEAYFAANAAAQA | 1 | 203 | 1 | 153 |
| | $76_{250}$ | E-G- | 1185 | NPMTVFWSKMAQSMT | 2 | 138 | 0 | — |
| 77 | $77_{188}$ | E-G- | 1192 | SPPVVSFRETVLDKS | 1 | 107 | 0 | — |
| | $77_{212}$ | E-G- | 1193 | NKHNRLYMEARPLEE | 1 | 107 | 0 | — |
| | $77_{403}$ | E-G- | 1198 | LPVIESFGFSATLRA | 0 | — | 1 | 333 |
| 78 | $78_{85}$ | E-G- | 1211 | ELAEMEVSAAFHLFS | 0 | — | 2 | 217 |
| | $78_{143}$ | E-G- | 1214 | KISLSKVRSFLTEAK | 0 | — | 1 | 783 |
| 79 | $79_{132}$ | E-G- | 1215 | QQYTAALSPILFECL | 1 | 183 | 0 | — |
| | $79_{138}$ | E-G- | 1216 | LSPILFECLIHPMLG | 1 | 83 | 0 | — |
| | $79_{160}$ | E-G- | 1217 | VEDNLVKLKNVLNVY | 1 | 100 | 0 | — |
| | $79_{11}$ | E-G- | 1219 | EVYEARLTKFKYLAG | 0 | — | 1 | 47 |
| | $79_{18}$ | E-G- | 1220 | TKFKYLAGDYLSLAD | 1 | 37 | 0 | — |
| | $79_{57}$ | E-G- | 1222 | VKAWWTDLLAKPSVQ | 1 | 100 | 1 | 23 |
| 80 | $80_{1}$ | E-G- | 1223 | KLRFTCLSSTGSSCL | 1 | 133 | 0 | — |
| | $80_{7}$ | E-G- | 1224 | LSSTGSSCLFVLILF | 1 | 147 | 1 | 63 |
| 81 | $81_{1}$ | E-G- | 1225 | EKLKKVLEVYEARLS | 2 | 100 | 0 | — |
| | $81_{18}$ | E-G- | 1226 | SYLAGDFVSFADLNH | 1 | 40 | 0 | — |
| 82 | $82_{109}$ | E-G- | 1234 | GDLYIFESRAICKYA | 1 | 290 | 0 | — |
| 83 | $83_{5}$ | E-G- | 1236 | ACSLFLNYAVSFNYF | 1 | 57 | 0 | — |
| | $83_{12}$ | E-G- | 1237 | YAVSFNYFVCNLLQE | 1 | 70 | 1 | 37 |
| | $83_{22}$ | E-G- | 1238 | NLLQERLKKLKSEHG | 1 | 83 | 1 | 47 |
| | $83_{54}$ | E-G- | 1239 | GMTGMLWETSLLDPE | 1 | 107 | 0 | — |
| | $83_{96}$ | E-G- | 1240 | PEGLLWLLLTGKVPT | 1 | 93 | 1 | 33 |
| | $83_{186}$ | E-G- | 1244 | IARLPQVASYVYRRI | 1 | 187 | 1 | 33 |
| | $83_{209}$ | E-G- | 1245 | ADNSLDYAANFSHML | 1 | 130 | 1 | 53 |
| | $83_{227}$ | E-G- | 1246 | DPKMLELMRLYITIH | 1 | 63 | 1 | 40 |
| | $83_{260}$ | E-G- | 1247 | ALSDPYLSFAAALNG | 1 | 130 | 1 | 70 |

TABLE 6-continued

Epitopes tested positive for T Cell Recognition

| Antigen | Peptide | Antibody reactvity IgE/IgG | SEQ ID NO: | Sequence | Total response IL-5 Events | SFC | Total response IFNg Events | SFC |
|---|---|---|---|---|---|---|---|---|
| | 83$_{266}$ | E-G- | 1248 | LSFAAALNGLAGPLH | 1 | 103 | 0 | — |
| | 83$_{306}$ | E-G- | 1251 | QLKEYVWKTLKSGKV | 1 | 90 | 1 | 40 |
| | 83$_{349}$ | E-G- | 1252 | EDPLFQLVSKLYEVV | 1 | 160 | 0 | — |
| | 83$_{355}$ | E-G- | 1253 | LVSKLYEVVPGILTE | 1 | 207 | 0 | — |
| | 83$_{384}$ | E-G- | 1254 | SGVLLNHFGLVEARY | 1 | 140 | 0 | — |
| | 83$_{400}$ | E-G- | 1255 | TVLFGVSRSMGIGSQ | 1 | 123 | 0 | — |
| | 83$_{412}$ | E-G- | 1256 | GSQLIWDRALGLPLE | 1 | 37 | 1 | 57 |
| 84 | 84$_{10}$ | E-G- | 1257 | GPVTILNWSFVRNDQ | 1 | 47 | 0 | — |
| | 84$_{69}$ | E-G- | 1260 | EHAFYLDWAVHSFRI | 1 | 53 | 1 | 303 |
| | 84$_{103}$ | E-G- | 1261 | FNDIIHSIINMDADV | 1 | 50 | 0 | — |
| | 84$_{165}$ | E-G- | 1263 | VNKMLAVLDTNILWV | 1 | 47 | 0 | — |
| 86 | 86$_{231}$ | E-G- | 1287 | IMQLLRDNLTLWTSD | 0 | — | 1 | 73 |
| 89 | 89$_{21}$ | E-G- | 1294 | EPAYFATAESVRDHL | 1 | 37 | 0 | — |
| | 89$_{53}$ | E-G- | 1295 | QTYYLSMEYLQGRAL | 1 | 37 | 0 | — |
| | 89$_{81}$ | E-G- | 1297 | AEAVKKFGYELEALA | 1 | 33 | 0 | — |
| | 89$_{131}$ | E-G- | 1299 | LRYRYGLFKQRIAKE | 0 | — | 1 | 663 |
| | 89$_{191}$ | E-G- | 1302 | GEVLNALAYDVPIPG | 2 | 288 | 1 | 1247 |
| | 89$_{460}$ | E-G- | 1213 | PRRWLRFCNPELSEI | 1 | 240 | 1 | 153 |
| | 89$_{540}$ | E-G- | 1214 | IKRIHEYKRQLMNIL | 0 | — | 2 | 45 |
| | 89$_{546}$ | E-G- | 1315 | YKRQLMNILGAVYRY | 2 | 78 | 1 | 43 |
| | 89$_{554}$ | E-G- | 1316 | LGAVYRYKKLKEMSA | 3 | 54 | 1 | 43 |
| | 89$_{583}$ | E-G- | 1317 | GKAFATYTNAKRIVK | 2 | 68 | 0 | — |
| | 89$_{593}$ | E-G- | 1318 | KRIVKLVNDVGAVVN | 1 | 77 | 2 | 195 |
| | 89$_{612}$ | E-G- | 1319 | VNKYLKVVFIPNYNV | 0 | — | 1 | 213 |
| | 89$_{619}$ | E-G- | 1320 | VFIPNYNVSVAEVLI | 2 | 28 | 6 | 259 |
| | 89$_{681}$ | E-G- | 1321 | EDNFFLFGAKADQVA | 2 | 35 | 2 | 202 |
| | 89$_{772}$ | E-G- | 1324 | KRWIKMSILNTAGSG | 1 | 107 | 3 | 136 |
| | 89$_{796}$ | E-G- | 1325 | QYAKEIWGITANPVP | 2 | 105 | 3 | 99 |
| 90 | 90$_{33}$ | E-G- | 1326 | KTLAVALGGARPLAT | 0 | — | 1 | 30 |
| | 90$_{45}$ | E-G- | 1327 | LATRGVATFTLPDLP | 0 | — | 2 | 30 |
| | 90$_{56}$ | E-G- | 1328 | PDLPYDYGALEPAIS | 2 | 37 | 1 | 67 |
| | 90$_{82}$ | E-G- | 1329 | HATYVANYNKALEQL | 0 | — | 1 | 57 |
| | 90$_{198}$ | E-G- | 1331 | DPLVTKGANLIPLLG | 0 | — | 0 | 87 |
| | 90$_{205}$ | E-G- | 1332 | ANLIPLLGIDVWEHA | 0 | — | 1 | 113 |
| | 90$_{218}$ | E-G- | 1333 | HAYYLQYKNVRPDYL | 1 | 80 | 2 | 48 |
| | 90$_{229}$ | E-G- | 1334 | PDYLTNIWKVVNWKY | 1 | 30 | 1 | 70 |
| 91 | 91$_{35}$ | E-G- | 1335 | APSGRIVMELYADVV | 3 | 246 | 2 | 82 |
| | 91$_{41}$ | E-G- | 1336 | VMELYADVVPKTAEN | 0 | — | 2 | 70 |
| | 91$_{74}$ | E-G- | 1337 | HYKGSSFHRVIPGFM | 3 | 208 | 1 | 207 |
| | 91$_{104}$ | E-G- | 1338 | SIYGAKFADENFIKK | 0 | — | 1 | 60 |
| | 91$_{135}$ | E-G- | 1339 | NGSQFFLCTAKTAWL | 1 | 530 | 2 | 130 |
| 92 | 92$_{1}$ | E-G- | 1340 | SQVHIRRPGGAGRDG | 0 | — | 1 | 113 |
| | 92$_{7}$ | E-G- | 1341 | RPGGAGRDGGQLRIP | 0 | — | 1 | 130 |
| | 92$_{13}$ | E-G- | 1342 | RDGGQLRIPSLLHGG | 0 | — | 1 | 97 |
| | 92$_{27}$ | E-G- | 1343 | GHGCAQPAMERRKHI | 0 | — | 2 | 233 |
| | 92$_{38}$ | E-G- | 1344 | RKHIEWNCDVCRHGD | 0 | — | 1 | 83 |
| 93 | 93$_{1}$ | E-G- | 1345 | WTTVMRASCGHHRFR | 0 | — | 1 | 87 |
| | 93$_{13}$ | E-G- | 1346 | RFRDCVISSLADFKL | 0 | — | 2 | 47 |
| | 93$_{19}$ | E-G- | 1347 | ISSLADFKLFPVLQH | 0 | — | 1 | 67 |
| | 93$_{29}$ | E-G- | 1348 | PVLQHIISIAVLAIF | 0 | — | 1 | 140 |
| | 93$_{35}$ | E-G- | 1349 | ISIAVLAIFIGLLMI | 0 | — | 2 | 123 |

REFERENCES

1. Brozek J L, et al. (2010) Allergic Rhinitis and its Impact on Asthma (ARIA) guidelines: 2010 revision. *J Allergy Clin Immunol* 126(3):466-476.
2. Nathan R A (2007) The burden of allergic rhinitis. *Allergy Asthma Proc* 28(1):3-9.
3. Bauchau V & Durham S R (2004) Prevalence and rate of diagnosis of allergic rhinitis in Europe. *Eur Respir J* 24(5):758-764.
4. Rolland J M, Douglass J, & O'Hehir R E (2000) Allergen immunotherapy: current and new therapeutic strategies. *Expert Opin Investig Drugs* 9(3):515-527.
5. Laprise C & Boulet L P (1996) Airway responsiveness and atopy in families of patients with asthma. *Clin Invest Med* 19(6):461-469.
6. Romagnani S (2000) The role of lymphocytes in allergic disease. *J Allergy Clin Immunol* 105(3):399-408.
7. Andersson K & Lidholm J (2003) Characteristics and immunobiology of grass pollen allergens. *Int Arch Allergy Immunol* 130(2):87-107.
8. Basketter D A & Kimber I (2011) Assessing the potency of respiratory allergens: uncertainties and challenges. *Regul Toxicol Pharmacol* 61(3):365-372.
9. Gieras A, et al. (2007) Molecular determinants of allergen-induced effector cell degranulation. *J Allergy Clin Immunol* 119(2):384-390.
10. Vijayanand P, et al. (2012) Interleukin-4 production by follicular helper T cells requires the conserved Il4 enhancer hypersensitivity site V. *Immunity* 36(2):175-187.
11. Mehlhop P D, et al. (1997) Allergen-induced bronchial hyperreactivity and eosinophilic inflammation occur in the absence of IgE in a mouse model of asthma. *Proc Natl Acad Sci USA* 94(4):1344-1349.
12. Oseroff C, et al. (2010) Molecular determinants of T cell epitope recognition to the common Timothy grass allergen. *J Immunol* 185(2):943-955.
13. Benitez D, et al. (2001) Specific immune response to *Phleum pratense* plant profilin in atopic patients and control subjects. *Allergol Immunopathol (Madr)* 29(1):9-15.
14. Wurtzen P A, van Neerven R J, Arnved J, Ipsen H, & Sparholt S H (1998) Dissection of the grass allergen-specific immune response in patients with allergies and control subjects: T-cell proliferation in patients does not correlate with specific serum IgE and skin reactivity. *J Allergy Clin Immunol* 101(2 Pt 1):241-249.
15. Oseroff C, et al. (2012) T Cell Responses to Known Allergen Proteins Are Differently Polarized and Account for a Variable Fraction of Total Response to Allergen Extracts. *J Immunol*.
16. Oseroff C, et al. (2012) Analysis of T Cell Responses to the Major Allergens from German Cockroach: Epitope Specificity and Relationship to IgE Production. *J Immunol* 189(2):679-688.
17. Sette A, et al. (2008) Selective CD4+ T cell help for antibody responses to a large viral pathogen: deterministic linkage of specificities. *Immunity* 28(6):847-858.
18. Lanzavecchia A (1985) Antigen-specific interaction between T and B cells. *Nature* 314(6011):537-539.
19. Chen C, et al. (2011) Identification of CD4+ T cell epitopes in *C. burnetii* antigens targeted by antibody responses. *PLoS One* 6(3):e17712.
20. Chain B M, Mitchison N A, Mitchison T J, Davies D H, & Marcinkiewicz J (1989) Antigen processing: current issues, exceptional cases (Thy 1 alloantigen, MHC class-II-restricted cytolytic T cells), and implications for vaccine development. J *Autoimmun* 2 Suppl:45-53.
21. Wang P, et al. (2008) A systematic assessment of MHC class II peptide binding predictions and evaluation of a consensus approach. *PLoS Comput Biol* 4(4): e1000048.
22. Wang P, et al. (2010) Peptide binding predictions for HLA DR, DP and DQ molecules. *BMC Bioinformatics* 11:568.
23. Lowenstein H (1978) Quantitative immunoelectrophoretic methods as a tool for the analysis and isolation of allergens. *Prog Allergy* 25:1-62.
24. Chapman M D (2008) Allergen nomenclature. *Clin Allergy Immunol* 21:47-58.
25. Petersen A, Schramm G, Schlaak M, & Becker W M (1998) Post-translational modifications influence IgE reactivity to the major allergen Phl p 1 of timothy grass pollen. *Clin Exp Allergy* 28(3):315-321.
26. Schuhbauer D M, Mitchison N A, & Mueller B (2000) Interaction within clusters of dendritic cells and helper T cells during initial Th1/Th2 commitment. *Eur J Immunol* 30(5):1255-1262.
27. Wachholz P A & Durham S R (2004) Mechanisms of immunotherapy: IgG revisited. *Curr Opin Allergy Clin Immunol* 4(4):313-318.
28. Skripak J M, et al. (2008) A randomized, double-blind, placebo-controlled study of milk oral immunotherapy for cow's milk allergy. *J Allergy Clin Immunol* 122(6):1154-1160.
29. Cady C T, et al. (2010) IgG antibodies produced during subcutaneous allergen immunotherapy mediate inhibition of basophil activation via a mechanism involving both FcgammaRIIA and FcgammaRIIB. *Immunol Lett* 130(1-2):57-65.
30. Terada T, Zhang K, Belperio J, Londhe V, & Saxon A (2006) A chimeric human-cat Fcgamma-Fel d1 fusion protein inhibits systemic, pulmonary, and cutaneous allergic reactivity to intratracheal challenge in mice sensitized to Fel d1, the major cat allergen. *Clin Immunol* 120(1): 45-56.
31. Wallner M, et al. (2009) Immunologic characterization of isoforms of Car b 1 and Que a 1, the major hornbeam and oak pollen allergens. *Allergy* 64(3):452-460.
32. Zerbino D R & Birney E (2008) Velvet: algorithms for de novo short read assembly using de Bruijn graphs. *Genome Res* 18(5):821-829.
33. Hannon G J (2010) FASTX-Toolkit http://hannonlab.cshl.edu/fastx_toolkit/%3E.
34. Surget-Groba Y & Montoya-Burgos J I (2010) Optimization of de novo transcriptome assembly from next-generation sequencing data. *Genome Res* 20(10): 1432-1440.1.

SEQUENCE LISTING (1442 sequences)

SEQ ID NO: 1 - protein, 390 aa, Phleum pratense
SDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGGMTSHRSGETEDTFIADLAVGLSTGQIKTGAPCRSERLAKYNQLLRIEEELGAAAVYAGLKFRAPVEPY

SEQ ID NO: 2 - protein, 389 aa, Phleum pratense
DYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGLKFRAPVEPY

SEQ ID NO: 3 - protein, 65 aa, Phleum pratense
GNPTVEVDVCCSDGTFARAAVPSGASTGVYEALELRDGGSDYLGKGVLKGNRANVELFHIAVLLA

SEQ ID NO: 4 - protein, 446 aa, Phleum pratense
PPPPAMAATIQSVKARQIFDSRGNPTVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGGMTSHRSGETEDTFIADLAVGLSTGQIKTGAPCRSERLAKYNQLLRIEEELGAAAVYAGLKFRA

SEQ ID NO: 5 - protein, 429 aa, Phleum pratense
GNPTVEVDVCCSDGTFARAAVPSGASTGVYEALELRDGGSDYLGKGVLKAVDNVNSIIGPALLGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGLKFRAPVEPY

SEQ ID NO: 6 - protein, 389 aa, Phleum pratense
DYLGKGVLKAVDNVNSIIGPALLGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGLKFRAPVEPY

SEQ ID NO: 7 - protein, 301 aa, Phleum pratense
ANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGLKFRA

SEQ ID NO: 8 - protein, 164 aa, Phleum pratense
LRFPKASRSIPPPPAMAATIQSVKARQIFDSRGNPTVEVDVCCSDGTFARAAVPSGASTGVYEALELRDGGSDYLGKGVLKAVDNVNSIIGPALLGKDPTEQTELDNFMVHQLDGTKNEWGWCKQKLGANAILAVSLAVCKAGALVKKIPLYQHIANLAGNKQL

SEQ ID NO: 9 - protein, 401 aa, Phleum pratense
RSIPPPPPAMAATIQSVKARQIFDSRGNPTVEVDVCCSDGTFARAAVPSGASTGVYEALELRDGGSDYLGKGVLKAVDNVNSIIGPALLGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFI

SEQ ID NO: 10 - protein, 352 aa, Phleum pratense
SDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGA

SEQ ID NO: 11 - protein, 160 aa, Phleum pratense
ASRSIPPPPPAMAATIQSVKARQIFDSRGNPTVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAVCKAGALVKKIPLYQHIANLAGNKQL

SEQ ID NO: 12 - protein, 336 aa, Phleum pratense
GNPTVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLL

SEQ ID NO: 13 - protein, 333 aa, Phleum pratense
TVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLL

SEQ ID NO: 14 - protein, 417 aa, Phleum pratense
TVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGL

SEQ ID NO: 15 - protein, 110 aa, Phleum pratense
GNPTVEVDVCCSDGTFARAAVPSGASTGVYEALELRDGGSDYLGKGVLKAVDNVNSIIGPALIGKDPTEQTELDNFMVHQLDGTKNEWGWCKQKVFFNISADADAGAVAR

SEQ ID NO: 16 - protein, 322 aa, Phleum pratense
AILAVSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGL

SEQ ID NO: 17 - protein, 98 aa, Phleum pratense
GNPTVEVDVCCSDGTFARAAVPSGASTGVYEALELRDGGSDYLGKGVLKAVDNVNSIIGPALIGKDPTEQTELDNFMVHQLDGTKNEWGWCKQKLGAN

SEQ ID NO: 18 - protein, 67 aa, Phleum pratense
IDPSSSSSPAMAATIQSVKARQIFDSRGNPTVEVDVCCSDGTFARAAVPSGASTGVYEALELRDGGS

SEQ ID NO: 19 - protein, 223 aa, Phleum pratense
IDPSSSSSPAMAATIQSVKARQIFDSRGNPTVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAVCKAGALVKKIPLYQHIANLAGNKQLVLPVPAFNVINGGSHAGNKLAMQEFMILPTGASSFKEAMKMGVEVYHNLKSVIKKKYGQDATNV

SEQ ID NO: 20 - protein, 274 aa, Phleum pratense
VSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIA

SEQ ID NO: 21 - protein, 154 aa, Phleum pratense
ALRFPKASRSIPPPPAMAATIQSVKARQIFDSRGNPTVEVDVCCSDGTFARAAVPSGASTGVYEALELRDGGSDYLGKGVLKAVDNVNSIIGPALIGKDPTEQTELDNFMVHQLDGTKNEWGWCKQKLGANAILAVSLAICKAGASVKKIPLYQ

SEQ ID NO: 22 - protein, 322 aa, Phleum pratense
VSLAVCKAGALVKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYGEKDQTYDLNFKEENNDGSQKISGDSLKNVYKSFVSEYPIVSIEDPFDQDDWVHYAKMTEEIGEQVQIVGDDLLVTNPTRVAKAIAEKSCNALLLKVNQIGSVTESIEAVKMSKRAGWGVMTSHRSGETEDTFIADLAVGLSTGQIKTGAPCRSERLAKYNQLLRIEEELGAAAVYAGLKFRA

SEQ ID NO: 23 - protein, 78 aa, Phleum pratense
ALRFPKASRSIPPPPAMAATIQSVKARQIFDSRGNPTVEVDVCCSDGTFARAAVPSGASTGVYEALELRDGGSDYLGK

SEQ ID NO: 24 - protein, 278 aa, Phleum pratense
YGFPIVQRFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLKGETVSNHDELMSNFFAQPDALAYGKNPEQLRSENVSENLIPHKTFKGNRPSLSFLLSSLSAYEIGQLLAIYEHRIAVQGFIWGINSFDQWGVELGKSLASQVRKQLHASRMEGKPVEGFNPSSASLLARYLAVEPSTPYDTTVLPKV

SEQ ID NO: 25 - protein, 202 aa, Phleum pratense
ENRSVLHVALRAPRDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGF

SEQ ID NO: 26 - protein, 172 aa, Phleum pratense
VKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFP

SEQ ID NO: 27 - protein, 346 aa, Phleum pratense
KLAEAAKLKEKIEKMFNGEKINSTENRSVLHVALRAPRDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQRFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFYDANK

SEQ ID NO: 28 - protein, 383 aa, Phleum pratense
KLAEAAKLKEKIEKMFNGEKINSTENRSVLHVALRAPRDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQRFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLKGETVSNHDELMSNFFAQPDALAYGKTPEQ

SEQ ID NO: 29 - protein, 165 aa, Phleum pratense
NGEKINSTENRSVLHVALRAPRDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAISKHMIAV

SEQ ID NO: 30 - protein, 167 aa, Phleum pratense
NGEKINSTENRSVLHVALRAPRDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVST

SEQ ID NO: 31 - protein, 146 aa, Phleum pratense
RDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVST

SEQ ID NO: 32 - protein, 442 aa, Phleum pratense
IKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQRFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLKGETVSNHDELMSNFFAQPDALASRKTPAPLRSENVSENLIPHKTFKGNRPSLSFLLSSLSAYEIGQLLAIYEHRIAVQGFIWGINSFDQWGVELGKSLASQVRKQLHASRMEGKPVEGFNPSSASLLARYLAVEPSTPYDTTVLPKV

SEQ ID NO: 33 - protein, 326 aa, Phleum pratense
IKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQRFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLKGETVSNHDELMSNFFAQPDALAYGKTPEHSR

SEQ ID NO: 34 - protein, 285 aa, Phleum pratense
AEFEGVFLDFARQQATTETVDKLFKLAEAAKLKEKIEKMFNGEKINSTENRSVLHVALRAPRDAVINSDGVNVVPEVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQRFLEGASSIDNHFRTASFEKNIPVLLGLLSV

SEQ ID NO: 35 - protein, 248 aa, Phleum pratense
EAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQRFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLK

SEQ ID NO: 36 - protein, 88 aa, Phleum pratense
ILLVFAETAEPEVKVVDLTILSPDRPDLVLPIPFVADEKGYAFALKDGSTYSFRFSFIVSNNIVSGLKYTNTVWKTGVRVENQKMMLG

SEQ ID NO: 37 - protein, 93 aa, Phleum pratense
LLGQVDTEQLGETAEPEVKVVDLTILSPDRPDLVLPIPFVADEKGYAFALKDGSTYSFRFSFIVSNNIVSGLKYTNTVWKTGVRVENQKMMLG

SEQ ID NO: 38 - protein, 90 aa, Phleum pratense
ETAEPEVKVVDLTILSPDRPDLVLPIPFVADEKGYAFALKDGSTYSFRFSFIVSNNIVSGLKYTNTVWKTGVRVENQKMMLGTFSPQPEP

SEQ ID NO: 39 - protein, 68 aa, Phleum pratense
VENQKMMLGTFSPQPEPYIYVGEEETTPAGIFARGSYSAKLKFVDDDGKVYLEMSYYFEIRKDWPTGQ

SEQ ID NO: 40 - protein, 50 aa, Phleum pratense
IYVGEEETTPAGIFARGSYSAKLKFVDDDGKVYLEMSYYFEIRKDWPTGQ

SEQ ID NO: 41 - protein, 97 aa, Phleum pratense
YSFRFSFIVSNNIVSGLKYTNTVWKTGVRVENQKMMLGTFSPQPEPYIYVGEEETTPAGIFARGSYSAKLKFVDDDGKVYLEMSYYFEIRKDWPTGQ

SEQ ID NO: 42 - protein, 94 aa, Phleum pratense
YSFRFSFIVSNNIVSGLKYTNTVWKTGVRVENQKMMLGTFSPQPEPYIYVGEEETTPAGIFARGSYSAKLKFVDDDGKVYLEMSYYFEIRKDWP

SEQ ID NO: 43 - protein, 97 aa, Phleum pratense
ETAEPEVKVVDLTILSPDRPDLVLPIPFVADEKGYAFALKDGSTYSFRFSFIVSNNIVSGLKYTNTVWKTGVRVENQKMMLGTFSPQPEPYIYVGEE

SEQ ID NO: 44 - protein, 74 aa, Phleum pratense
WKTGVRVENQKMMLGTFSPQPEPYIYVGEEETTPAGIFARGSYSAKLKFVDDDGKVYLEMSYYFEIRKDWPTGQ

SEQ ID NO: 45 - protein, 77 aa, Phleum pratense
EQLGETAEPEVKVVDLTILSPDRPDLVLPIPFVADEKGYAFALKDGSTYSFRFSFIVSNNIVSGLKYTNTVWKTGVR

SEQ ID NO: 46 - protein, 379 aa, Phleum pratense
MKTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPLVDVALKLSKIKEYTGRSAPTVIT

SEQ ID NO: 47 - protein, 379 aa, Phleum pratense; identical to SEQ ID NO: 46

SEQ ID NO: 48 - protein, 384 aa, Phleum pratense
PSPFNSRTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPLVDVALKLSKIKEYTGRSAPTVIT

SEQ ID NO: 49 - protein, 384 aa, Phleum pratense; identical to SEQ ID NO: 48

SEQ ID NO: 50 - protein, 304 aa, Phleum pratense
KLMKTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVS

SEQ ID NO: 51 - protein, 381 aa, Phleum pratense
KLMKTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPLVDVALKLSKIKEYTGRSAPTVIT

SEQ ID NO: 52 - protein, 381 aa, Phleum pratense; identical to SEQ ID NO: 51

SEQ ID NO: 53 - protein, 378 aa, Phleum pratense
KTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPLVDVALKLSKIKEYTGRSAPTVIT

SEQ ID NO: 54 - protein, 358 aa, Phleum pratense
KLMKTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPL

SEQ ID NO: 55 - protein, 372 aa, Phleum pratense
NSRTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPLVDVALKLSKIKEYTG

SEQ ID NO: 56 - protein, 215 aa, Phleum pratense
GWKFFGNLMDAGMCSVCGEESFGTGSDHIREKDGIWAVLAWLSIIAYKNKDNLGGDKLVSVEDIVLQHWATYGRHYYTRYDYENVDAEAAKELMANLVKMQSALSDVNKLIKEIQPDVAEVVSADEFEYKDPVDGSVSKHQGIRYLFGDGSRLVFRLSGTGSVGATIRIYIEQYEKDSSKTGRESSDALSPLVDVALKLSKIKEYTGRSAPTVIT

SEQ ID NO: 57 - protein, 246 aa, Phleum pratense
DEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 58 - protein, 258 aa, Phleum pratense
GAMAAKCYPTVSDEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 59 - protein, 253 aa, Phleum pratense
KCYPTVSDEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 60 - protein, 164 aa, Phleum pratense
KCYPTVSDEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVALSGGHTLG

SEQ ID NO: 61 - protein, 254 aa, Phleum pratense
AKCYPTVSDEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEGPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 62 - protein, 144 aa, Phleum pratense
VAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVAL

SEQ ID NO: 63 - protein, 240 aa, Phleum pratense
VAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 64 - protein, 264 aa, Phleum pratense
AFPHPIGAMAAKCYPTVSDEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEGPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 65 - protein, 275 aa, Phleum pratense
HPDPQPHSSPTPRAFPIGAMAAKCYPTVSDEYLAAVAKARRKLRGLIAEKNCAPLMLRIAWHSAGTFDVATKTGGPFGTMRCPAELAHGANAGLDIAVRLLEPIKEQVPILSYADFYQLAGVVAVEITGGPEVPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 66 - protein, 147 aa, Phleum pratense
GGPEVPFHPGRQDKTEPPPEGRLPDATLGSDHLRQVFTAQMGLSDQDIVALSGGHTLGRCHKERSGFEGAWTANPLIFDNSYFTELLTGEKEGLLQLPTDKTLLTDPAFRPLVDKYAADEDAFFADYAEAHLKLSELGFGEATEGCC

SEQ ID NO: 67 - protein, 281 aa, Phleum pratense
AGLPQISDNEKSGFISLVSRYLSGEEEHIEWPKIHTPTDEVVVPYDTIDAPPEDLEATKALLDKLAVLKLNGGLGTTMGCTGPKSVIEVRNGFTFLDLIVLQIESLNKKYGSNVPLLLMNSFNTHEDTLKIVEKYANSSIDIHTFNQSQYPRVVADEFLPWPSKGKTDKDGWYPPGHGDIFPSLMNSGKLDLLLSQGKEYVFIANSDNLGAIVDMKILNHLIHKQNEYCMEVTPKTLADVKGGTLISYEGRVQLLEIAQVPDAHVDEFKSIEKFKIFNTNN

SEQ ID NO: 68 - protein, 115 aa, Phleum pratense
EVDGVKVLQLETAAGAAIRFFDHAIGINVPRSRFLPVKATSDLQLVQSDLYTLVDGFVTRNSARTDPSNPSIELGPEFKKVGCFLGRFKSIPSIVELDSLKVSGDVWFGSGIVLK

SEQ ID NO: 69 - protein, 115 aa, Phleum pratense
EVDGVKVLQLETAAGAAIRFFDHAIGINVPRSRFLPVKATSDLQLVQSDLYTLVDGFVTRNSARTDPSNPSIELGPEFKKVGSFLGRFKSIPSIVELDSLKVSGDVWFGSGIVLK

SEQ ID NO: 70 - protein, 186 aa, Phleum pratense
FIANSDNLGAIVDMKILNHLIHKQNEYCMEVTPKTLADVKGGTLISYEGRVQLLEIAQVPDAHVDEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNSARTDPSNPSIELGPEFKK

SEQ ID NO: 71 - protein, 115 aa, Phleum pratense; identical to SEQ ID NO: 69

SEQ ID NO: 72 - protein, 351 aa, Phleum pratense
TLLFPHTQISLPSVRTRKHLAATMADEKLAKLREAVAGLPQISDNEKSGFISLVSRYLSGDEEHIEWPKIHTPTDEVVVPYDTIDAPPEDLEATKALLNKLAVLKLNGGLGTTMGCTGPKSVIEVRNGFTFLDLIVLQIESLNKKYGSNVPLLLMNSFNTHEDTLKIVEKYANSSIDIHTFNQSQYPRVVADEFLPWPSKGKTDKDGWYPPGHGDIFPSLMNSGKLDLLLSQGKEYVFIANSDNLGAIVDMKILNHLIHKQNEYCMEVTPKTLADVKGGTLISYEGRVQLLEIAQVPDAHVDEFKSIEKFKIFNTNNLWVNLKAIKRLVEADALKMEIIPNPKEVDTVNFF

SEQ ID NO: 73 - protein, 271 aa, Phleum pratense
YDTVDAPPEDLEATKALLNKLAVLKLNGGLGTTMGCTGPKSVIEVRNGFTFLDLIVLQIESLNKKYGSNVPLLLMNSFNTHEDTLKIVEKYANSSIDIHTFNQSQYPRVVADEFLPWPSKGKTDKDGWYPPGHGDIFPSLMNSGKLDLLLSQGKEYVFIANSDNLGAIVDMKILNHLIHKQNEYCMEVTPKTLADVKGGTLISYEGRVQLLEIAQVPDAHVDEFKSIEKFKIFNTNNLWVNLKAIKRLVEADALKMEIIPNPKEVDTVNFF

SEQ ID NO: 74 - protein, 265 aa, Phleum pratense
EDLEATKALLDKLAVLKLNGGLGTTMGCTGPKSVIEVRNGFTFLDLIVLQIESLNKKYGSNVPLLLMNSFNTHEDTLKIVEKYANSSIDIHTFNQSQYPRVVADEFLPWPSKGKTDKDGWYPPGHGDIFPSLMNSGKLDLLLSQGKEYVFIANSDNLGAIVDMKILNHLIHKQNEYCMEVTPKTLADVKGGTLISYEGRVQLLEIAQVPDAHVDEFKSIEKFKIFNTNNLWVNLKAIKRLVEADALKMEIIPNPKEVDTVNFFRV

SEQ ID NO: 75 - protein, 261 aa, Phleum pratense
GKLRLVFEGKDETVDLEVFNFTGAGGVALAMYNTDESIQGFAEASMAIAYEKKWPLYLSTKNTILKKYDGRFKDIFQAVYEADWKSKYEAAGIWYEHRLIDDMVAYALKSEGGYVWACKNYDGDVQSDFLAQGFGSLGLMTSVLMCPDGKNIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 76 - protein, 270 aa, Phleum pratense
ATDAVLKGPGKLRLVFEGKDETVDLEVFNFTGAGGVALAMYNTDESIQGFAEASMAIAYEKKWPLYLSTKNTILKKYDGRFKDIFQAVYEADWKSKYEAAGIWYEHRLIDDMVAYALKSEGGYVWACKNYDGDVQSDFLAQGFGSLGLMTSVLMCPDGKNIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 77 - protein, 83 aa, Phleum pratense
YPLFCRFKDIFQAVYEADWKSKYEAAGIWYEHRLIDDMVAYALKSEGGYVWACKNYDGDVQSDFLAQGFGSLGLMTSVLMCPD

SEQ ID NO: 78 - protein, 110 aa, Phleum pratense
IEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 79 - protein, 87 aa, Phleum pratense
STNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 80 - protein, 315 aa, Phleum pratense
PFSLCLLPSGTVFREPIICKNVPKLVPGWTKPICIGRHAFGDQYRATDAVLKGPGKLRLVFEGKDETVDLEVFNFTGAGGVALAMYNTDESIQGFAEASMAIAYEKKWPLYLSTKNTILKKYDGRFKDIFQAVYEADWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 81 - protein, 344 aa, Phleum pratense
YNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVALAMYNTDESIQGFAEASMAIAYEKKWPLYLSTKNTILKKYDGRFKDIFQAVYEADWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 82 - protein, 251 aa, Phleum pratense
DETVDLEVFNFTGAGGVALAMYNTDESIQGFAEASMAIAYEKKWPLYLSTKNTILKKYDGRFKDIFQAVYEADWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 83 - protein, 251 aa, Phleum pratense
DETVDLEVFNFTGAGGVALAMYNTDESIQGFAEASMAIAYEKKWPLYLSTKNTILKKYDGRFKDIFQAVYEADWKSKYEAAGIWYEHRLIDDMVAYALKSEGGYVWACKNYDGDVQSDFLAQGFGSLGLMTSVLMCPDGKPIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 84 - protein, 89 aa, Phleum pratense
STNSIASIFAWTRGLAHRAKLDDNARLLDFTQKLEDACVGTVESGKMTKDLALLVHGSSKVTRGDYLNTEEFIDAVAAELQSRLAANCV

SEQ ID NO: 85 - protein, 448 aa, Phleum pratense
ILVTPDGNFNTAGMLVVQSGCWTMLKGGATSFAAGKGELFFETNVTAELMVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVMCLTDKNFKNLPVGDVVDKLITEWKAVPEDAKTDDKGVFEAELFHGEYNVTVKHKSLKEPLMHTVDLDSKSEATIRAKK

SEQ ID NO: 86 - protein, 364 aa, Phleum pratense
GNFNTAGMLVVQSGCWTMLKGGATSFAAGKGELFFETNVTAELMVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVM

SEQ ID NO: 87 - protein, 526 aa, Phleum pratense
YSANIECEKEPPKPLYGGGILTGAEAPAPVSAGGKKLLMAKSKSAPAKGSTLKVELEKDTHYTLSAWLQLSKSTGDVKAILVTPDGNFNTAGMLVVQSGCWTMLKGGATSFAAGKGELFFETNVTAELVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVMCLTDKNFKNLPVGDVVDKLITEWKAVPEDAKTDDKGVFEAELFHGEYNVTVKHKSLKEPLMHTVDLDSKSEATIRAKK

SEQ ID NO: 88 - protein, 575 aa, Phleum pratense
HTTIVASGIENMKIFTRTWVLLLLVVLLFEGCLAKSYKSEKSDKSATYDYSANIECEKEPPKPLYGGGILTGAEAPAPVSAGGKKLLMAKSKSAPAKGSTLKVELEKDTHYTLSAWLQLSKSTGDVKAILVTPDGNFNTAGMLVVQSGCWTMLKGGATSFAAGKGELFFETNVTAELVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVMCLTDKNFKNLPVGDVVDKLITEWKAVPEDAKTDDKGVFEAELFHGEYNVTVKHKSLKEPLMHTVDLDSKSEATIRAKK

SEQ ID NO: 89 - protein, 400 aa, Phleum pratense
LMVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVMCLTDKNFKNLPVGDVVDKLITEWKAVPEDAKTDDKGVFEAELFHGEYNVTVKHKSLKEPLMHTVDLDSKSEATIRAKK

SEQ ID NO: 90 - protein, 579 aa, Phleum pratense
ALTHTTIVASGIENMKIFTRTWVLLLLVVLLFEGCLAKSYKSEKSDKSATYDYSANIECEKEPPKPLYGGGILTGAEAPAPVSAGGKKLLMAKSKSAPAKGSTLKVELEKDTHYTLSAWLQLSKSTGDVKAILVTPDGNFNTAGMLVVQSGCWTMLKGGATSFAAGKGELFFETNVTAELMVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVMCLTDKNFKNLPVGDVVDKLITEWKAVPEDAKTDDKGVFEAELFHGEYNVTVKHKSLKEPLMHTVDLDSKSEATIRAKK

SEQ ID NO: 91 - protein, 486 aa, Phleum pratense
SKSAPAKGSTLKVELEKDTHYTLSAWLQLSKSTGDVKAILVTPDGNFNTAGMLVVQSGCWTMLKGGATSFAAGKGELFFETNVTAELMVDSMSLQPFSFEEWKSHRHESIAKERKKKVKITVHGSDGKVLPDAELSLERVAKGFPLGNAMTKEILDIPEYEKWFTSRFTVATMENEMKWYSTEYDQNQELYEIPDKMLALAEKYNISVRGHNVFWDDQSKQMDWVSKLSAPQLKKAMEKRMKNVVSRYAGKLIHWDVLNENLHYSFFEDKLGKDASAEVFKEVAKLDDKPILFMNEYNTIEEPNDAAPLPTKYLAKLKQIQSYPGNSKLKYGIGLESHFDTPNIPYVRGSLDTLAQAKVPIWLTEIDVKKGPKQVEYLEEVMREGFAHPGVKGIVLWGAWHAKECYVMCLTDKNFKNLPVGDVVDKLITEWKAVPEDAKTDDKGVFEAELFHGEYNVTVKHKSLKEPLMHTVDLDSKSEATIRAKK

SEQ ID NO: 92 - protein, 360 aa, Phleum pratense
VSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVWKLVVP

SEQ ID NO: 93 - protein, 364 aa, Phleum pratense
VLTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVWKLVVPQ

SEQ ID NO: 94 - protein, 312 aa, Phleum pratense
LTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAI

SEQ ID NO: 95 - protein, 265 aa, Phleum pratense
RGGRRERRRPKMAQLQETYACSPATERGRGILLGGDAKTDTIVYCAGRTFFFRRLDAPLDAWTYTEHAYPTTVARISPNGEWVASADVSGCVRVWGRNGDRALKAEFRPISGRVDDLRWSPDGLRIVVSGDGKGKSLVRAFMWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQVLTVSAD

SEQ ID NO: 96 - protein, 620 aa, Phleum pratense
TLPDQSEEGERRRPKMAQLQETYACSPATERGRGILLGGDAKTDTIVYCAGRTFFFRRLDAPLDAWTYTEHAYPTTVARISPNGEWVASADVSGCVRVWGRNGDRALKAEFRPISGRVDDLRWSPDGLRIVVSGDGKGKSLVRAFMWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQVLTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVW

SEQ ID NO: 97 - protein, 282 aa, Phleum pratense
GITTLHSHPTRGPTLPDQSEEGERRRPKMAQLQETYACSPATERGRGILLGGDAKTDTIVYCAGRTVFFRRLDAPLDAWTYTEHAYPTTVARISPNGEWVASADVSGCVRVWGRNGDRALKAEFRPISGRVDDLRWSPDGLRIVVSGDGKGKSLVRAFMWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQVLTVSAD

SEQ ID NO: 98 - protein, 275 aa, Phleum pratense
GITTLHSHPTRGPTLPDQSEEGERRRPKMAQLQETYACSPATERGRGILLGGDAKTDTIVYCAGRTFFFRRLDAPLDAWTYTEHAYPTTVARISPNGEWVASADVSGCVRVWGRNGDRALKAEFRPISGRVDDLRWSPDGLRIVVSGDGKGKSLVRAFMWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQ

SEQ ID NO: 99 - protein, 366 aa, Phleum pratense
SWSADSKQVLTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVW

SEQ ID NO: 100 - protein, 513 aa, Phleum pratense
SSAPWAAVVIQKFILSCSFIPGIQSYAKFSEMCRWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQVLTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVWKLVVP

SEQ ID NO: 101 - protein, 509 aa, Phleum pratense
GSSAPWAAVVIQKFILSCSFIPGIQSYAKFSEMCRWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQVLTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVW

SEQ ID NO: 102 - protein, 335 aa, Phleum pratense
CTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIVYDVDKPASSRITIKGAHLGGVHGLTFADNDTLVTAGEDACVRVWKLVVP

SEQ ID NO: 103 - protein, 531 aa, Phleum pratense
CVRVWGRNGDRALKAEFRPISGRVDDLRWSPDGLRIVVSGDGKGKSLVRAFMWDSGSTVGDFDGHSKRVLSCDFKPTRPFRIVTCGEDFLANYYEGPPFKFKHSIRDHSNFVNCIRYSPDGSKFITVSSDKRGLIYDGKTGDKIGELSSEDSHTGSIYAVSWSADSKQVLTVSADKTAKVWDIMEDASGKVNRTLVCTGIGGVDDMLVGCLWQNDHLVTVSLGGTFNVFSASNPDKEPVSFAGHLKTVSSLTYFPQSNPRTMLSTSYDGVIIRWIQGVGYGGRLIRKNNTQIKCFVAAEEELITSGYDNMVFRIPLNGDQCGDAESVDVGGQPNALNIAVQQPEFALITTDSAIVLLHKSTVTSTTKVSYTITSSAVSPDGTEAIVGAQDGKLRIYSISGDTLTEEAVLERHRGAITSIHYSPDVSMFASADANREAVAWDRATREIKLKNMLFHTARINCLAWSPDSRLVATGSIDTCAIIYDVDKPASSRITIKGAHLGGVHGLTFADNDTLVTAGEDACVRVWKLVVP

SEQ ID NO: 104 - protein, 71 aa, Phleum pratense
GATIVVSGDGRYFSKDAVQIITKMAAANGVRRVWVGQDSLLSTPAVSAIIRERIAADGSKATGAFILTASH

SEQ ID NO: 105 - protein, 287 aa, Phleum pratense
RLDQVQLLVKGASERGAKRIRLHILADGRDVLDGSSVGFVETLENDLAQLREKGVDAQVASGGGRMYVTMDRYENDWDVVKRGWDAQVLGEAPYKFKSALEAVKTLRAEPKANDQYLPAFVIVDESGKSVGPIVDGDAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGKFDQVRINLPN

SEQ ID NO: 106 - protein, 232 aa, Phleum pratense
ESFAEGTLHLIGLLSDGGVHSRLDQVQLLVKGASERGAKRIRLHILTDGRDVLDGSSVGFVETLENDLAQLREKGVDAQVASGGGRMYVTMDRYENDWDVVKRGWDAQVLGEAPYKFKSALEAVKTLRAEPKANDQYLPAFVIVDESGKSVGPIVDGDAVVTFNFRADRMVMLAKALEFADFDKFDRVRVPKIKYAGMLQYDGELKLPNKFLVSPPLIERTSGEYLVKNGVR

SEQ ID NO: 107 - protein, 184 aa, Phleum pratense
RDVLDGSSVGFVETLENDLAQLREKGVDAQVASGGGRMYVTMDRYENDWDVVKRGWDAQVLGEAPYKFKSALEAVKTLRAEPKANDQYLPAFVIVDESGKSVGPIVDGDAVVTFNFRADRMVMLAKALEFADFDKFDRVRVPKIKYAGMLQYDGELKLPNKFLVSPPLIERTSGEYLVKNGVRT

SEQ ID NO: 108 - protein, 150 aa, Phleum pratense
DAVVTFNFRADRMVMLAKALEFADFDKFDRVHVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGKFDQVRINLP

SEQ ID NO: 109 - protein, 151 aa, Phleum pratense
DAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGKFDQVRINLPN

SEQ ID NO: 110 - protein, 302 aa, Phleum pratense
ESENVKEFSYINLFLVSLYFQLLVKGASERGAKRIRLHILTDGRDVLDGSSVGFVETLENDLAQLREKGVDAQVASGGGRMYVTMDRYENDWDVVKRGWDAQVLGEAPYKFKSALEAVKTLRAEPKANDQYLPAFVIVDESGKSVGPIVDGDAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGKFDQVRINLPN

SEQ ID NO: 111 - protein, 229 aa, Phleum pratense
VTSGGGRMYVTMDRYENDWDVVKRGWDAQVLGEAPYKFKSALEAVKALRAEPKANDQYLPAFVIVDESGKSVGPIVDGDAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGKFDQVRINLPN

SEQ ID NO: 112 - protein, 152 aa, Phleum pratense
GRMYVTMDRYENDWDVVKRGWDAQVLGEAPYKFKSALEAVKTLRAEPKANDQYLPAFVIVDESGKSVGPIVDGDAVVTFNFRADRMVMLAKALEFADFDKFDRVRVPKIKYAGMLQYDGELKLPNKFLVSPPLIERTSGEYLVKNGVRTFAC

SEQ ID NO: 113 - protein, 141 aa, Phleum pratense
DAVVTFNFRADRMVMLAKALEFADFDKFDRVRVPKIKYAGMLQYDGELKLPNKFLVSPPLIERTSGEYLVKNGVRTFACSETVKFGHVTFFWNGNRSGYFDETKEEYIEIPSDSGITFNEQPKMKALEIAEKTRDAILSGK

SEQ ID NO: 114 - protein, 132 aa, Phleum pratense
KESFAEGTLHLIGLLSDGGVHSRLDQVQLLVKGASERGAKRIRLHILTDGRDVLDGSSVGFVETLENDLAQLREKGVDAQVASGGGRMYVTMDRYENDWDVVKRGWDAQVLGEAPYKFKSALEAVKTLRAEP

SEQ ID NO: 115 - protein, 37 aa, Phleum pratense
CSSDYKLLCSSFPVIPYHQGRNGNLSALACPLNQKKK

SEQ ID NO: 116 - protein, 40 aa, Phleum pratense
CSSDYKLLCSSFPVITYHQGRNGNLSALACPLNQKKKKKK

SEQ ID NO: 117 - protein, 40 aa, Phleum pratense; identical to SEQ ID NO: 116

SEQ ID NO: 118 - protein, 411 aa, Phleum pratense
AMDEEYDVIVLGTGLKECILSGLLSVDGLKVLHMDRNDYYGGESTSLNLTKIWKRFKGSEATPDHLGVSKEYNVDMVPKFMMANGALVRVLIRTSVTKYLNFKAVDGSFVYNNGKIHKVPATDVEALKSNLMGLFEKRRARKFFIYVQDYEEEDPKSHEGLDLHKVTTREVISKYGLEDDTVDFIGHALALHRDDNYLDEPAIDTVKRMKLYAESLARFQGGSPYIYPLYGLGELPQAFARLSAVYGGTYMLNKPECKVEFDESGKAFGVTSEGETAKCKKVVCDPSYLPDKVTKVGRVARAICIMKHPIPDTKDSHSVQIILPKKQLKRKSDMYVFCCSYAHNVAPKGKFIAFVSTEAETDKPEIELKPGIDLLGPVEETFFDIYDRYEPANAPEEDNCFVTNSYDATTH

SEQ ID NO: 119 - protein, 411 aa, Phleum pratense; identical to SEQ ID NO: 118

SEQ ID NO: 120 - protein, 175 aa, Phleum pratense
TTREVISKYGLEDDTVDFIGHALALHRDDNYLDEPAIDTVKRMKLYAESLARFQGGSPYIYPLYGLGELPQAFARLSAVYGGTYMLNKPECKVEFDESGKAFGVTSEGETAKCKKVVCDPSYLPDKVTKVGRVARAICIMKHPIPDTKDSHSVQIILPKKQLKRKSDMYVFCCSY

SEQ ID NO: 121 - protein, 342 aa, Phleum pratense
AMDEEYDVIVLGTGLKECILSGLLSVDGLKVLHMDRNDYYGGESTSLNLTKIWKRFKGSEATPDHLGVSKEYNVDMVPKFMMANGALVRVLIRTSVTKYLNFKAVDGSFVYNNGKIHKVPATDVEALKSNLMGLFEKRRARKFFIYVQDYEEEDPKSHEGLDLHKVTTREVISKYGLEDDTVDFIGHALALHRDDNYLDEPAIDTVKRMKLYAESLARFQGGSPYIYPLYGLGELPQAFARLSAVYGGTYMLNKPECKVEFDESGKAFGVTSEGETAKCKKVVCDPSYLPDKVTKVGRVARAICIMKHPIPDTKDSHSVQIILPKKQLKRKSDMYVFCCSYA

SEQ ID NO: 122 - protein, 426 aa, Phleum pratense
LLSVDGLKVLHMDRNDYYGGESTSLNLTKIWKRFKGSEATPDHLGVSKEYNVDMVPKFMMANGALVRVLIRTSVTKYLNFKAVDGSFVYNNGKIHKVPATDVEALKSNLMGLFEKRRARKFFIYVQDYEEEDPKSHEGLDLHKVTTREVISKYGLEDDTVDFIGHALALHRDDNYLDEPAIDTVKRMKLYAESLARFQGGSPYIYPLYGLGELPQAFARLSAVYGGTYMLNKPECKVEFDESGKAFGVTSEGETAKCKKVVCDPSYLPDKVTKVGRVARAICIMKHPIPDTKDSHSVQIILPKKQLKRKSDMYVFCCSYAHNVAPKGKFIAFVSTEAETDKPEIELKPGIDLLGPVEETFFDIYDRYEPANAPEEDNCFVTNSYDATTHFETTVKDVLALYSKITGKELDLSVDLNAASAGESEAA

SEQ ID NO: 123 - protein, 326 aa, Phleum pratense
MDEEYDVIVLGTGLKECILSGLLSVDGLKVLHMDRNDYYGGESTSLNLTKIWKRFKGSEATPDHLGVSKEYNVDMVPKFMMANGALVRVLIRTSVTKYLNFKAVDGSFVYNNGKIHKVPATDVEALKSNLMGLFEKRRARKFFIYVQDYEEEDPKSHEGLDLHKVTTREVISKYGLEDDTVDFIGHALALHRDDNYLDEPAIDTVKRMKLYAESLARFQGGSPYIYPLYGLGELPQAFARLSAVYGGTYMLNKPECKVEFDESGKAFGVTSEGETAKCKKVVCDPSYLPDKVTKVGRVARAICIMKHPIPDTKDSHSVQIILPKKQ

SEQ ID NO: 124 - protein, 25 aa, Phleum pratense
LLGYLLWVVAIRRPRPVRCFSLRAW

SEQ ID NO: 125 - protein, 25 aa, Phleum pratense
LLGYLLWVVAIRRPRPVRCFSLRAW

SEQ ID NO: 126 - protein, 25 aa, Phleum pratense
LLGYLLWVVAIRRPRPVRCFSLRAW

SEQ ID NO: 127 - protein, 25 aa, Phleum pratense
LLGYLLWVVAIRRPRPVRCFSLRAW

SEQ ID NO: 128 - protein, 16 aa, Phleum pratense
PRVNFFKRYNLTCVFW

SEQ ID NO: 129 - protein, 25 aa, Phleum pratense
PRVNFFKRYNLTCVFWSKKKKKNSS

SEQ ID NO: 130 - protein, 87 aa, Phleum pratense
RSDEKLLSVFREGVVYGAGIGPGVYDIHSPRIPSKEEIADDFALFRGTRPPRRPKKRPRTLQRQIDSLCPGFCLADVTPETYRIEER

SEQ ID NO: 131 - protein, 28 aa, Phleum pratense
NVCTRLSPFCCLYCILCCWYSMRLVTVM

SEQ ID NO: 132 - protein, 28 aa, Phleum pratense
NVCTRLSPFCCLYCILCCWYSMRLVTVM

SEQ ID NO: 133 - protein, 28 aa, Phleum pratense
NVCTRLSPFCCLYCILCCWYSMRLVTVM

SEQ ID NO: 134 - protein, 28 aa, Phleum pratense
NVCTRLSPFCCLYCILCCWYSMRLVTVM

SEQ ID NO: 135 - protein, 28 aa, Phleum pratense
NVCTRLSPFCCLYCILCCWYSMRLVTVM

SEQ ID NO: 136 - protein, 43 aa, Phleum pratense
NIPATWGAMEKLYDAGKARAIGVSNLASKKLGDLLAVARIPPA

SEQ ID NO: 137 - protein, 81 aa, Phleum pratense
DVNHATVKTSSGEKPVRELVQDDEWLNGPFIATVQQRGAAIIKARKLSSALSAASSACDHIRDWVLGTPEGTFVSMGVYSD

SEQ ID NO: 138 - protein, 362 aa, Phleum pratense
LKTEESRPSPKPNRIERRKREEHAPPPGQHIAMAASSRRASQLLGSAASRFLHSRGYAAAAAAPSPAVFVDKSTRVICQGITGKNGTFHTEQAIEYGTNMVGGVTPKKGGTEHLGLPVFNSVAEAKAETKANASVIYVPPPFAAAAIMEALEAELDLVVCITEGIPQHDMVKVKAALNRQSKTRLIGPNCPGIIKPGECKIGIMPGYIHKPGRIGIVSRSGTLTYEAVFQTTAVGLGQSTCVGMGGDPFNGTNFVDCLEKFVADPQTEGIVLIGEIGGTAEEDAAAFIQASKTDKPVVAFIAGLTAPPGRRMGHAGAIVSGGKGTAQDKIKALREAGVTVVESPAKIGSTMFEIFKQRGMVE

SEQ ID NO: 139 - protein, 357 aa, Phleum pratense
SRPSPKPNRIERRKREEHAPPPGQHIAMAASSRRASQLLGSAASRFLHSRGYAAAAAAPSPAVFVDKSTRVICQGITGKNGTFHTEQAIEYGTNMVGGVTPKKGGTEHLGLPVFNSVAEAKAETKANASVIYVPPPFAAAAIMEALEAELDLVVCITEGIPQHDMVKVKAALNRQSKTRLIGPNCPGIIKPGECKIGIMPGYIHKPGRIGIVSRSGTLTYEAVFQTTAVGLGQSTCVGMGGDPFNGTNFVDCLEKFVADPQTEGIVLIGEIGGTAEEDAAAFIQASKTDKPVVAFIAGLTAPPGRRMGHAGAIVSGGKGTAQDKIKALREAGVTVVESPAKIGSTMFEIFKQRGMVE

SEQ ID NO: 140 - protein, 302 aa, Phleum pratense
AAAPSPAVFVDKSTRVICQGITGKNGTFHTEQAIEYGTNMVGGVTPKKGGTEHLGLPVFNSVAEAKAETKANASVIYVPPPFAAAAIMEALEAELDLVVCITEGIPQHDMVKVKAALNRQSKTRLIGPNCPGIIKPGECKIGIMPGYIHKPGRIGIVSRSGTLTYEAVFQTTAVGLGQSTCVGMGGDPFNGTNFVDCLEKFVADPQTEGIVLIGEIGGTAEEDAAAFIQASKTDKPVVAFIAGLTAPPGRRMGHAGAIVSGGKGTAQDKIKALREAGVTVVESPAKIGSTMFEIFKQRGMVE

SEQ ID NO: 141 - protein, 159 aa, Phleum pratense
MPGYIHKPGRIGIVSRSGTLTYEAVFQTTAVGLGQSTCVGMGGDPFNGTNFVDCLEKFVADPQTEGIVLIGEIGGTAEEDAAAFIQASKTDKPVVAFIAGLTAPPGRRMGHAGAIVSGGKGTAQDKIKALREAGVTVVESPAKIGSTMFEIFKQRGMVE

SEQ ID NO: 142 - protein, 264 aa, Phleum pratense
QQVGGVTPKKGGTEHLGLPVFNSVAEAKAETKANASVIYVPPPFAAAAIMEALEAELDLVVCITEGIPQHDMVKVKAALNRQSKTRLIGPNCPGIIKPGECKIGIMPGYIHKPGRIGIVSRSGTLTYEAVFQTTAVGLGQSTCVGMGGDPFNGTNFVDCLEKFVADPQTEGIVLIGEIGGTAEEDAAAFIQASKTDKPVVAFIAGLTAPPGRRMGHAGAIVSGGKGTAQDKIKALREAGVTVVESPAKIGSTMFEIFKQRGMVE

SEQ ID NO: 143 - protein, 271 aa, Phleum pratense
EVLTSKRQQVGGVTPKKGGTEHLGLPVFNSVAEAKAETKANASVIYVPPPFAAAAIMEALEAELDLVVCITEGIPQHDMVKVKAALNRQSKTRLIGPNCPGIIKPGECKIGIMPGYIHKPGRIGIVSRSGTLTYEAVFQTTAVGLGQSTCVGMGGDPFNGTNFVDCLEKFVADPQTEGIVLIGEIGGTAEEDAAAFIQASKTDKPVVAFIAGLTAPPGRRMGHAGAIVSGGKGTAQDKIKALREAGVTVVESPAKIGSTMFEIFKQRGMVE

SEQ ID NO: 144 - protein, 43 aa, Phleum pratense
LRVQSDQAVFYQCYFDGYQDTLYTHAQRQFFRDCTVTGTIDFI

SEQ ID NO: 145 - protein, 52 aa, Phleum pratense
DGSGDFKTIKEALAKVPPKSASMYVMYIKEGTYKEYVTVPRTVTNLVMIGDG

SEQ ID NO: 146 - protein, 53 aa, Phleum pratense
VALRVQSDQAVFYQCYFDGYQDTLYTHAQRQFFRDCTVTGTIDFIFWITTWEL

SEQ ID NO: 147 - protein, 72 aa, Phleum pratense
MKDIRVENTAGADNHQAVALRVQSDQAVFYQCYFDGYQDTLYTHAQRQFFRDCTVTGTIDFIFGNSQVVIQN

SEQ ID NO: 148 - protein, 63 aa, Phleum pratense
MKDIRVENTAGADNHQAVALRVQSDQAVFYQCYFDGYQDTLYTHAQRQFFRDCTVTGTIDFIF

SEQ ID NO: 149 - protein, 63 aa, Phleum pratense
LAKVPPKSASMYVMYIKEGTYKEYVTVPRTVTNLVMIGDGAAKTIITGNKNFKMNLTSMVAVS

SEQ ID NO: 150 - protein, 57 aa, Phleum pratense
LAKVPPKSASMYVMYIKEGTYKEYVTVPRTVTNLVMIGDGAAKTIITGNKNFKMNLT

SEQ ID NO: 151 - protein, 57 aa, Phleum pratense; identical to SEQ ID NO: 150

SEQ ID NO: 152 - protein, 55 aa, Phleum pratense
DTATMEAIGNGFFMKDIRVENTAGADNHQAVALRVQSDQAVFYQCYFDGAVTEEL

SEQ ID NO: 153 - protein, 60 aa, Phleum pratense
LAKVPPKSASMYVMYIKEGTYKEYVTVPRTVTNLVMIGDGAAKTIITGNKNFKMNLTTKD

SEQ ID NO: 154 - protein, 70 aa, Phleum pratense
TKDTATMEAIGNGFFMKDIRVENTAGADNHQAVALRVQSDQAVFYQCYFDGYQDTLYTHAQRQFFRDCTV

SEQ ID NO: 155 - protein, 68 aa, Phleum pratense
DTATMEAIGNGFFMKDIRVENTAGADNHQAVALRVQSDQAVFYQCYFDGYQDTLYTHAQRQFFRDCTV

SEQ ID NO: 156 - protein, 59 aa, Phleum pratense
EAIGNGFFMKDIRVENTAGADNHQAVALRVQSDQAVFYQCYFDGYQDTLYTLMSFMKNP

SEQ ID NO: 157 - protein, 64 aa, Phleum pratense
AKVPPKSASMYVMYIKEGTYKEYVTVPRTVTNLVMIGDGAAKTIITGNKNFKMNLTSMVAVSLV

SEQ ID NO: 158 - protein, 63 aa, Phleum pratense
AKVPPKSASMYVMYIKEGTYKEYVTVPRTVTNLVMIGDGAAKTIITGNKNFKMNLTTKDTATM

SEQ ID NO: 159 - protein, 41 aa, Phleum pratense
KSASMYVMYIKEGTYKEYVTVPRTVTNLVMIGDGATKTIIT

SEQ ID NO: 160 - protein, 53 aa, Phleum pratense
VPPKSASMYVMYIKEGTYKEYVTVPRTVTNLVMIGDGAAKTIITGNKNFKMNL

SEQ ID NO: 161 - protein, 75 aa, Phleum pratense
DTATMEAIGNGFFMKDIRVENTAGADNHQAVALRVQSDQAVFYQCYFDGYQDTLYTHAQRQFFRDCTVTGTIDFI

SEQ ID NO: 162 - protein, 71 aa, Phleum pratense
SASMYVMYIKEGTYKEYVTVPRTVTNLVMIGDGAAKTIITGNKNFKMNLTTKDTATMEAIGNGFFMKDIRV

SEQ ID NO: 163 - protein, 71 aa, Phleum pratense
GSGDFKTIKEALAKVPPKSASMYVMYIKEGTYKEYVTVPRTVTNLVMIGDGAAKTIILKFLLPVMIVLAAP

SEQ ID NO: 164 - protein, 73 aa, Phleum pratense
GSGDFKTIKEALAKVPPKSASMYVMYIKEGTYKEYVTVPRTVTNLVMIGDGAAKTIITGNKNFKMNLTTKDTA

SEQ ID NO: 165 - protein, 226 aa, Phleum pratense
PALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 166 - protein, 238 aa, Phleum pratense
PAPPPTQHLPSPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 167 - protein, 246 aa, Phleum pratense
VLLLRRTPPRSSSYPTVASPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 168 - protein, 237 aa, Phleum pratense
APPPTQQQPSPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 169 - protein, 230 aa, Phleum pratense
MPSPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 170 - protein, 239 aa, Phleum pratense
PPAPPPTQQQPSPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 171 - protein, 265 aa, Phleum pratense
APTSASTGSPNSDSNTRVLLLRRTSPFSAPPPTQQLPSPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 172 - protein, 229 aa, Phleum pratense
PSPPALVPMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 173 - protein, 120 aa, Phleum pratense
NQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCG

SEQ ID NO: 174 - protein, 217 aa, Phleum pratense
NQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDANIHFVEAVALKPPEVTFDLAMQQQHEAELAAAAAQPLPDDDDDLVE

SEQ ID NO: 175 - protein, 27 aa, Phleum pratense
RTSSWGSGASLKIDRRELVTTRIYGFL

SEQ ID NO: 176 - protein, 27 aa, Phleum pratense
RTSSWGSGASLKIDRRELVTTRIYGFL

SEQ ID NO: 177 - protein, 247 aa, Phleum pratense
LVQRSRRFDLRFLHAAVAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFT

SEQ ID NO: 178 - protein, 351 aa, Phleum pratense
SRSPPIRSRFLHAAVAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGNSLVEEDKLELATSLIETAKAKGVSLLLPTDVVVADKFAPDAESKTVPADAIPDGWMGLDVGPDSIKTFSEALDTTKTVIWNGPMGVFEFEKFAAG

SEQ ID NO: 179 - protein, 352 aa, Phleum pratense
SRSPPIRSRFLHAAVAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVPADAIPDGWMGLDVGPDSIKTFSEALDTTKTVIWNGPMGVFEFEKFAAGT

SEQ ID NO: 180 - protein, 354 aa, Phleum pratense
RPDRRRFDLGFLHAAVAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGNSLVEEDKLELATSLIETAKAKGVSLLLPTDVVVADKFAPDAESKTVSADAIPDGWMGLDVGPDSIKTFSEALDTTKTVIWNGPMGVFEFEKFAAGTD

SEQ ID NO: 181 - protein, 342 aa, Phleum pratense
LHAAVAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGNSLVEEDKLELATSLIETAKAKGVSLLLPTDVVVADKFAPDAESKTVSADAIPDGWMGLDVGPDSIKTFSEALDTTKTVIWNGPMGVFEFEKFAAGT

SEQ ID NO: 182 - protein, 338 aa, Phleum pratense
AMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGNSLVEEDKLELATSLIETAKAKGVSLLLPTDVVVADKFAPDAESKTVSADAIPDGWMGLDVGPDSIKTFSEALDTTKTVIWNGPMGVFEFEKFAAGTD

SEQ ID NO: 183 - protein, 354 aa, Phleum pratense
SLSLSLSLSRPDRRRFDLRFLHAAVAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPEGWMGLDVGPDSIKTFSEALDTTKTVIWNGPMGVFE

SEQ ID NO: 184 - protein, 353 aa, Phleum pratense
LPRPDRRRFDPGFSTQQAAMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPEGWMGLDVGPDSIKTFSEALDTTKTVIWNGPMGVFEFEKFAA

SEQ ID NO: 185 - protein, 353 aa, Phleum pratense; identical to SEQ ID NO: 184

SEQ ID NO: 186 - protein, 273 aa, Phleum pratense
FQGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPDGWMGLDVGPDSIKTFSEALDTTKTVIWNGPMGVFEFEKFAAGT

SEQ ID NO: 187 - protein, 336 aa, Phleum pratense
AMATKRSVGTLGEADLKGKKVFLRADLNVPLDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPDGWMGLDVGPDSIKTFSEALDTTKTVIWNGPMGVFEFEKFAAG

SEQ ID NO: 188 - protein, 278 aa, Phleum pratense
VILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPDGWMGLDVGPDSIKTFSEALDTTKTVIWNGPMGVFEFEKFAAGT

SEQ ID NO: 189 - protein, 279 aa, Phleum pratense
VILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPDGWMGLDVGPDSIKTFSEALDTTKTVIWNGPMGVFEFEKFAAGTD

SEQ ID NO: 190 - protein, 288 aa, Phleum pratense
LDDAQKITDDTRIRASIPTIKFLLEKGAKVILASHLGRPKGVTPKFSLKPLVPRLSELLGVEVVMANDCIGEEVEKLAAALPEGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGKAVGKSLVEEDKLELATSLIETAKAKGVSLLLPTDVVVADKFAPDAESKTVSADAIPDGWMGLDVGPDSIKTFSEALDTTKT

SEQ ID NO: 191 - protein, 16 aa, Phleum pratense
KSAPALRILRSFPSHS

SEQ ID NO: 192 - protein, 68 aa, Phleum pratense
VAAIKEESEGNLKGILGYVDEDLVSTDFQGDSRSSIFDAKAGIALNDNFVKLVSWYDNEWGYSTRVVD

SEQ ID NO: 193 - protein, 66 aa, Phleum pratense
YMFKYDTVHGQWKHHDVKVKDAKTLLFGEKEVAVFGCRNPEEIPWGAAGADYVVESTGVFTDKDKA

SEQ ID NO: 194 - protein, 84 aa, Phleum pratense
AATYEQIKAAIKEESEGNLKGILGYVDEDLVSTDFQGDSRSSIFDAKAGIALNDNFVKLVSWYDNEWGYSTRVVDLIRHIHATK

SEQ ID NO: 195 - protein, 77 aa, Phleum pratense
VAAIKEESEGNLKGILGYVDEDLVSTDFQGDSRSSIFDAKAGIALNDNFVKLVSWYDNEWGYSTRVVDLIRHIHATK

SEQ ID NO: 196 - protein, 129 aa, Phleum pratense
ATQKTVDGPSSKDWRGGRAASFNIIPSSTGAAKAVGKVLPVLNGKLTGMAFRVPTVDVSVVDLTVRLEKAATYEQIKAAIKEESEGNLKGILGYVDEDLVSTDFQGDSRSSIFDAKAGNALNDNFVKLV

SEQ ID NO: 197 - protein, 60 aa, Phleum pratense
TYMFKYDTVHGQWKHHDVKVKDAKTLLFGEKEVAVFGCRNPEEIPWGAAGADYVVESTGV

SEQ ID NO: 198 - protein, 72 aa, Phleum pratense
EESEGNLKGILGYVDEDLVSTDFQGDSRSSIFDAKAGIALNDNFVKLVSWYDNEWGYSTRVVDLIRHIHATK

SEQ ID NO: 199 - protein, 290 aa, Phleum pratense
VNDPFITTDYMTYMFKYDTVHGQWKHHDVKVKDAKTLLFGEKEVAVFGCRNPEEIPWGAAGADYVVESTGVFTDKDKAAAHIKGGAKKVIISAPSKDAPMFVCGVNEKEYTSDITIVSNASCTTNCLAPLAKVINDRFGIVEGLMTTVHAMTATQKTVDGPSSKDWRGGRAASFNIIPSSTGAAKAVGKVLPVLNGKLTGMAFRVPTVDVSVVDLTVRLEKAATYEQIKAAIKEESEGNLKGILGYVDEDLVSTDFQGDSRSSIFDAKAGIALNDNFVKLVSWYDNEWGY

SEQ ID NO: 200 - protein, 222 aa, Phleum pratense
DVELVAVNDPFITTDYMTYMFKYDTVHGQWKHHDVKVKDAKTLLFGEKEVAVFGCRNPEEIPWGAAGADYVVESTGVFTDKDKAAAHIKGGAKKVIISAPSKDAPMFVCGVNEKEYTSDITIVSNASCTTNCLAPLAKVINDRFGIVEGLMTTVHAMTATQKTVDGPSSKDWRGGRAASFNIIPSSTGAAKAVGKVLPVLNGKLTGMAFRVPTVDVSVVDLT

SEQ ID NO: 201 - protein, 84 aa, Phleum pratense
DVELVAVNDPFITTDYMTYMFKYDTVHGQWKHHDVKVKDAKTLLFGEKEVAVFGCRNPEEIPWGAAGADYVVESTGVFTDKDKA

SEQ ID NO: 202 - protein, 202 aa, Phleum pratense
DVELVAVNDPFITTDYMTYMFKYDTVHGQWKHHDVKVKDAKTLLFGEKEVAVFGCRNPEEIPWGAAGADYVVESTGVFTDKDKAAAHIKGGAKKVIISAPSKDAPMFVCGVNEKEYTSDITIVSNASCTTNCLAPLAKVINDRFGIVEGLMTTVHAMTATQKTVDGPSSKDWRGGRAASFNIIPSSTGAAKAVGKVLPVLNG

SEQ ID NO: 203 - protein, 286 aa, Phleum pratense
DVELVAVNDPFITTDYMTYMFKYDTVHGQWKHHDVKVKDAKTLLFGEKEVAVFGCRNPEEIPWGAAGADYVVESTGVFTDKDKAAAHIKGGAKKVIISAPSKDAPMFVCGVNEKEYTSDITIVSNASCTTNCLAPLAKVINDRFGIVEGLMTTVHAMTATQKTVDGPSSKDWRGGRAASFNIIPSSTGAAKAVGKVLPVLNGKLTGMAFRVPTVDVSVVDLTVRLEKAATYEQIKAAIKEESEGNLKGILGYVDEDLVSTDFQGDSRSSIFDAKAGIALNDNFVKL

SEQ ID NO: 204 - protein, 69 aa, Phleum pratense
PGSDAKKVAPEVIAEYTVRTLQRTVPPAVPAIVFLSGGQSEEEATVNLNAMYKLQTKKPWFLSFSFGRA

SEQ ID NO: 205 - protein, 106 aa, Phleum pratense
VTPGSDAKKVAPEVIAEYTVRTLQRTVPPAVPAIVFLSGGQSEEEATVNLNAMNKLQTKKPWFLSFSFGRALQQSTLKAWSGKEENVEKAQKAFLVRCKANSEATL

SEQ ID NO: 206 - protein, 74 aa, Phleum pratense
KPNMVTPGSDAKKVAPEVIAEYTVRTLQRTVPPAVPAIVFLSGGQSEEEATVNLNAMNKLQTKKPWFLSFSFGR

SEQ ID NO: 207 - protein, 98 aa, Phleum pratense
LKPNMVTPGSDAKKVAPEVIAEYTVRTLQRTVPPAVPAIVFLSGGQSEEEATVNLNAMNKLQTKKPWFLSFSFGRALQQSTLKAWSGKEENVEKAQKA

SEQ ID NO: 208 - protein, 202 aa, Phleum pratense
SQLSIDQNAQGLARYAIICQENGLVPIVEPEILVDGPHDIERCAYVTEVVLAACYKALNDQHVLLEGSLLKPNMVTPGSDAKKVAPEVIAEYTVRTLQRTVPPAVPAIVFLSGGQSEEEATVNLNAMNKLQTKKPWFLSFSFGRALQQSTLKAWSGKEENVEKAQKAFLVRCKANSEATLGTYKGDATLGEGASESLHVKDY

SEQ ID NO: 209 - protein, 130 aa, Phleum pratense
VTPGSDAKKVAPEVIAEYTVRTLQRTVPPAVPAIVFLSGGQSEEEATVNLNAMNKLQTKKPWFLSFSFGRALQQSTLKAWSGKEENVEKAQKAFLVRCKANSEATLGTYKGDATLGEGASESLHVKDYKY

SEQ ID NO: 210 - protein, 63 aa, Phleum pratense
KETTTQGHDDLGKRCAKYYEAGARFAKWRAVLKIGPNEPSQLSIDQNAQGLARYAMLGFRREP

SEQ ID NO: 211 - protein, 76 aa, Phleum pratense
RFAKWRAVLKIGPNEPSQLSIDQNAQGLARYAIICQENGLVPIVEPEILVDGPHDIERCAYVTEVVLAACYKALND

SEQ ID NO: 212 - protein, 50 aa, Phleum pratense
GSLLKPNMVTPGSDAKKVAPEVIAEYTVRTLQRTVPPAVPAIVFLSGGQS

SEQ ID NO: 213 - protein, 201 aa, Phleum pratense
PFANPPQTSTMSAYCGKYKDELIKNAAYIGTPGKGILAADESTGTIGKRFASINVENVEDNRRALRELLFTTPGALQHISGVILFEETLYQSSKAGKPFVDILKENNVLPGIKVDKGTVELAGTDKETTTQGHDDLGKRCAKYYEAGARFAKWRAVLKIGPNEPSQLSIDQNAQGLARYAIICQENGLVPIVEPEILVDGP

SEQ ID NO: 214 - protein, 51 aa, Phleum pratense
VIPPAPHLKRWNRVVDTNLESPNDIVPEGAPFTGSGYRIAPYSSILLKATS

SEQ ID NO: 215 - protein, 51 aa, Phleum pratense; identical to SEQ ID NO: 214

SEQ ID NO: 216 - protein, 405 aa, Phleum pratense
GGVAAGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKVARAQPPA

SEQ ID NO: 217 - protein, 398 aa, Phleum pratense
GGVAAGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKV

SEQ ID NO: 218 - protein, 443 aa, Phleum pratense
LPRSFIHPSTDRSLAEMASEKHFKYVILGGGVAAGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKVARAQPPASDLEALGKE

SEQ ID NO: 219 - protein, 351 aa, Phleum pratense
RRRRRGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNV

SEQ ID NO: 220 - protein, 379 aa, Phleum pratense
LAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKVAR

SEQ ID NO: 221 - protein, 412 aa, Phleum pratense
KQRASAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKVARAQPPASDLEALGKE

SEQ ID NO: 222 - protein, 416 aa, Phleum pratense
IHPSTDRWLAEMASEKHFKYVILGGGVAAGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADEN

SEQ ID NO: 223 - protein, 426 aa, Phleum pratense
SFRFFLAHSSIHPSTDRSLAEMASEKHFKYVILGGGVAAGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADEN

SEQ ID NO: 224 - protein, 433 aa, Phleum pratense
SSFRFFLAHSSIHPSTDRSLAEMASEKHFKYVILGGGVAAGYAAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGINIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKV

SEQ ID NO: 225 - protein, 391 aa, Phleum pratense
AAREFAKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAEANNILYLRDINDADKLVAAMQAKKDGKAVVVGGGYIGLELSAALKLNNFDVTMVYPEPWCMPRLFTAGIAHFYEGYYASKGITIVKGTVASGFDADANGDVAVVKLKDGRVLDANIVIVGVGGRPLTGLFKGQVDEEKGGLKTDTFFETSVAGVYAIGDVASFPMKLYNEPRRVEHVDHARKSAEQAVKAIKAKESGETVAEYDYLPYFYSRSFDIAWQFYGDNVGESVLFGDNDPAAAKAKFGTYWVKDGKVVGVFLEGGSADENQAIAKV

SEQ ID NO: 226 - protein, 351 aa, Phleum pratense
MAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLV

SEQ ID NO: 227 - protein, 353 aa, Phleum pratense
REMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLV

SEQ ID NO: 228 - protein, 351 aa, Phleum pratense; identical to SEQ ID NO: 226

SEQ ID NO: 229 - protein, 351 aa, Phleum pratense; identical to SEQ ID NO: 226

SEQ ID NO: 230 - protein, 351 aa, Phleum pratense; identical to SEQ ID NO: 226

SEQ ID NO: 231 - protein, 572 aa, Phleum pratense
REMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLGVVISGAIRVHDDMLLAASEALAEQVSQENFDKGLIFPPFTNIRKISANIAAKVAAKAYDLGLASRLPRPDDLVKYAESCMYTPLYRSYR

SEQ ID NO: 232 - protein, 483 aa, Phleum pratense
REMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLG

SEQ ID NO: 233 - protein, 510 aa, Phleum pratense
PEMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLGVVISGAIRVHDDMLLAASEALAEQVSQ

SEQ ID NO: 234 - protein, 572 aa, Phleum pratense
PEMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLGVVISGAIRVHDDMLLAASEALAEQVSQENFDKGLIFPPFTNIRKISANIAAKVAAKAYDLGLASRLPRPDDLVKYAESCMYPPLYRSYR

SEQ ID NO: 235 - protein, 571 aa, Phleum pratense
EMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLGVVISGAIRVHDDMLLAASEALAEQVSQENFDKGLIFPPFTNIRKISANIAAKVAAKAYDLGLASRLPRPDDLVKYAESCMYPPLYRSYR

SEQ ID NO: 236 - protein, 571 aa, Phleum pratense
EMAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLGVVISGAIRVHDDMLLAASEALAEQVSQENFDKGLIFPPFTNIRKISANIAAKVAAKAYDLGLASRLPRPDDLVKYAESCMYTPLYRSYR

SEQ ID NO: 237 - protein, 571 aa, Phleum pratense; identical to SEQ ID NO: 236

SEQ ID NO: 238 - protein, 299 aa, Phleum pratense
MAGGGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLA

SEQ ID NO: 239 - protein, 529 aa, Phleum pratense
GGVEDVYGEDRATEEQFVTPWSFSVASGHSLLRDPRHNKGLAFSEAERDAHYLRGLLPPAIVSQEHQEKKIMHNLRQYTVPLQRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNQTLLDDEYYIGLKQRRATGEEYHELLQEFMNAVKQNYGEKVLVQFEDFANHNAFDLLAKYSKSHLVFNDDIQGTASVVLAGLLAALKVIGGGLADQTYLFLGAGEAGTGIAELIALEMSKHTDLPLDDCRKKIWLVDSKGLLVESRKESLQHFKKPFAHEHEPLTTLLEAVQSLKPTVLIGTSGVGKTFTQEVVEAMASFNEKPVIFSLSNPTSHSECTAEEAYTWTKGTAVFASGSPFDPVEYEGKTYVPGQSNNAYVFPGFGLGVVISGAIRVHDDMLLAASEALAEQVSQENFDKGLIFPPFTNIRKISANIAA

SEQ ID NO: 240 - protein, 54 aa, Phleum pratense
ICASGQIIRKGFYLTKNVEHKGQVDLVTETDKACEDLIFNHLRKLYPDHKFIGE

SEQ ID NO: 241 - protein, 101 aa, Phleum pratense
IDFYSTITRARFEEMNMDLFRKCMEPVEKCLSDAKMDKSTVHDVVLVGGSTRIPKVQQLLQDFFNGKELCKSINPDEAVAYGAAVQAAILSGEGNEKVQDL

SEQ ID NO: 242 - protein, 150 aa, Phleum pratense
VQEFKRKNKKDISGNPRALRRLRTACERAKRTLSSTAQTTIEIDSLFEGIDFYSTITRARFEELNMDLFRKCMEPVEKCLRDAKMDKSTVHDVVLVGGSTRIPKVQQLLQDFFNGKELCKSINPDEAVAYGAAVQAAILSGEGNEKVQDL

SEQ ID NO: 243 - protein, 150 aa, Phleum pratense
VQEFKRKHKKDMTGNPRALRRLRTACERAKRTLSSTAQTTIEIDSLFEGIDFYSTITRARFEELNMDLFRKCMEPVEKCLRDAKMDKSTVHDVVLVGGSTRIPKVQQLLQDFFNGKELCKSINPDEAVAYGAAVQAAILSGEGNEKVQDL

SEQ ID NO: 244 - protein, 93 aa, Phleum pratense
IDFYSTITRARFEEMNMDLFRKCMEPVEKCLRDAKMDKSTVHDVVLVGGSTRIPKVQQLLQDFFNGKELCKSINPDEAVAYGAAVQAAILSGE

SEQ ID NO: 245 - protein, 75 aa, Phleum pratense
RARFEEMNMDLFRKCMEPVEKCLRDAKMDKSTVHDVVLVGGSTRIPKVQQLLQDFFNGKELCKSINPDEAVAYGA

SEQ ID NO: 246 - protein, 51 aa, Phleum pratense
VEKCLRDAKMDKSTVHDVVLVGGSTRIPKVQQLLQDFFNGKELCKSINPDE

SEQ ID NO: 247 - protein, 128 aa, Phleum pratense
ETAGGVMTTLIPRNTTIPTKKEQVFSTYSDNQPGVLIQVYEGERARTRDNNLLGKFELSGIPPAPRGVPQITVCFDIDANGILNVSAEDKTTGQKNKITITNDKGRLSKEDIEKMVQEAERYKAEDEE

SEQ ID NO: 248 - protein, 116 aa, Phleum pratense
RNTTIPTKKEQVFSTYSDNQPGVLIQVYEGERARTRDNNLLGKFELSGIPPAPRGVPQITVCFDIDANGILNVSAEDKTTGQKNKITITNDKGRLSKEDIEKMVQEAERYKAEDEE

SEQ ID NO: 249 - protein, 59 aa, Phleum pratense
AKMDKSTVHDVVLVGGSTRIPKVQQLLQDFFNGKELCKSINPDEAVAYGAAVQAAILSG

SEQ ID NO: 250 - protein, 71 aa, Phleum pratense
AAILRGEGNEKVQDLLLLDVTPLSLGLETAGGVMTTLIPRNTTIPTKKEQVFSTYSDNQPGVLIQVYEGER

SEQ ID NO: 251 - protein, 106 aa, Phleum pratense
CKSINPDEAVAYGAAVQAAILSGEGNEKVQDLLLLDVTPLSLGLETAGGVMTVLIPRNTTIPTKKEQVFSTYSDNQPGVLIQVYEGERARTRDNNLLGKFELSGIP

SEQ ID NO: 252 - protein, 98 aa, Phleum pratense
RPWRTAPPSRPPSSAARATRRCRTCFLLDVTPLSLGLETAGGVMTTLIPRNTTIPTKKEQVFSTYSDNQPGVLIQVYEGERARTRDNNLLGKFELSGI

SEQ ID NO: 253 - protein, 74 aa, Phleum pratense
KKEQVFSTYSDNQPGVLIQVYEGERTRTRDNNLLGKFELSGIPPAPRGVPQITVCFDIDANGILNVSAEDKTTG

SEQ ID NO: 254 - protein, 59 aa, Phleum pratense
RNTTIPTKKEQVFSTYSDNQPGVLIQVYEGERARTRDNNLLGKFELSGIPPAPRGVPQI

SEQ ID NO: 255 - protein, 61 aa, Phleum pratense
LFRKCMEPVEKCLRDAKMDKSTVHDVVLVGGSTRIPKVQQLLQDFFNGKELCKSINPDEAV

SEQ ID NO: 256 - protein, 67 aa, Phleum pratense
EELNMDLFRKCMEPVEKCLRDAKMDKSTVHDVVLVGGSTRIPKVQQLLQDFFNGKELCKSINPDEAV

SEQ ID NO: 257 - protein, 43 aa, Phleum pratense
KKEQVFSTYSDNQPGVLIQVYEGERARTKDNNLLGKFELSGIP

SEQ ID NO: 258 - protein, 88 aa, Phleum pratense
ELIKATDSWMEASEMLYPDYDSMIPDYDTVITNVRRSLAVAKKNHLAWNCERCRKGESKKKIDAISEGNDLGKIIAVLSAFVDPPVTK

SEQ ID NO: 259 - protein, 61 aa, Phleum pratense
YDTVITKVRRSLAVAKKNHLAWNCERCRKGESKKTVDAISEGNDLEKIIAILSAFVDAATK

SEQ ID NO: 260 - protein, 61 aa, Phleum pratense
YDTVITNVRRSLAVAKKNHLAWNCERCRKGESKKTVDAISEGNDLEKIVAILSAFVDAATK

SEQ ID NO: 261 - protein, 49 aa, Phleum pratense
YDTVITNVRRSLAVAKKNHLAWNCERCRKGESKKTVDAILSAFVDAATK

SEQ ID NO: 262 - protein, 52 aa, Phleum pratense
RSLAVAKKNHLAWNCERCRKGESKKTVDAISEGNDLEKIVAILSAFVDAATK

SEQ ID NO: 263 - protein, 71 aa, Phleum pratense
PDYDSMIPDYDTVITNVRRSLAVAKKNHLAWNCERCRKGESKKKIDAISEGNDLGKIIAVLSAFVDPPVTK

SEQ ID NO: 264 - protein, 74 aa, Phleum pratense
KGYNISLASMIPDYDTVITNVRRSLAVAKKNHLAWNCERCRKGESKKTVDAISEGNDLEKIVAILSAFVDAATK

SEQ ID NO: 265 - protein, 68 aa, Phleum pratense
YDSMIPDYDTVITNVRRSLAVAKKNHLAWNCERCRKGESKKTVDAISEGNDLEKIVAILSAFVDAATK

SEQ ID NO: 266 - protein, 73 aa, Phleum pratense
GYNISLASMIPDYDTVITNVRRSLAVAKKNHLAWNCERCRKGESKKTVDAISEGNDLEKIVAILSAFVDAATK

SEQ ID NO: 267 - protein, 129 aa, Phleum pratense
QEMAYWSLKAAIEIGNGAADAASSLYLFGENLPRGADTCYADCHTELIKATDSWMEASEMLYPDYDSMIPDYDTVITNVRRSLAVAKKNHLAWNCERCRKGESKKTVDAISEGNDLEKIVAILSAFVDA

SEQ ID NO: 268 - protein, 330 aa, Phleum pratense
EEEVEVAPPQAMEVRVKILFTALCHTDVYFWEAKGQTPVFPRIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSV

SEQ ID NO: 269 - protein, 313 aa, Phleum pratense
NWFCSWVTAAAVAWEAGKPLSIEEVEVAPPQAMEVRVKILFTALCHTDVYFWEAKGQTPVFPRIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNER

SEQ ID NO: 270 - protein, 344 aa, Phleum pratense
CKAAVAWEAGKPLSIEEVEVAPPQAMEVRVKILFTALCHTDVYFWEAKGQTPVFPRIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSV

SEQ ID NO: 271 - protein, 310 aa, Phleum pratense
EAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSVTFSEINKAFDLMAKGEGIRCIIRMEH

SEQ ID NO: 272 - protein, 315 aa, Phleum pratense
RIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSVTFSEINKAFDLMAKGEGIRCIIRMEH

SEQ ID NO: 273 - protein, 379 aa, Phleum pratense
SFSWICACVRAAAVAWEAGKPLSIEEVEVAPPQAMEVRVKILFTALCHTDVYFWEAKGQTPVFPRIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSVTFSEINKAFDLMAKGEGIRCIIRMEH

SEQ ID NO: 274 - protein, 317 aa, Phleum pratense
LMSFSWICACVRAAAVAWEAGKPLSIEEVEVAPPQAMEVRVKILFTALCHTDVYFWEAKGQTPVFPRIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNER

SEQ ID NO: 275 - protein, 366 aa, Phleum pratense
VAWEAGKPLSIEEVEVAPPQAMEVRVKILFTALCHTDVYFWEAKGQTPVFPRIFGHEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSVTFSEINKAFDLMAKGEGIRCIIRMEH

SEQ ID NO: 276 - protein, 261 aa, Phleum pratense
VFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSVT

SEQ ID NO: 277 - protein, 311 aa, Phleum pratense
HEAGGIVESVGEGVTDVAPGDHVLPVFTGECKECRHCKSAESNMCDLLRINTDRGVMISDGKSRFSIDGKPIFHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLAEMTDGGVDRSVECTGNINAMIQAFECVHDGWGVAVLVGVPHKDAEFKTHPMNFLNERTLKGTFFGNFKPRTDLPNVVEMYMKKELEVEKFITHSVTFSEINKAFDLMAKGEGIRCIIRMEH

SEQ ID NO: 278 - protein, 73 aa, Phleum pratense
ALRWNLQMGHSVLPKSVSEERIKQNLDVYDWSIPDDLLAKFSEIKQTRLLMGNFIVNKDSVYKTHEELWDGEI

SEQ ID NO: 279 - protein, 43 aa, Phleum pratense
QDFKKVNEIYAKYFPSPAPARSTYQVAALPLDARIEIECIAAL

SEQ ID NO: 280 - protein, 43 aa, Phleum pratense; identical to SEQ ID NO: 279

SEQ ID NO: 281 - protein, 19 aa, Phleum pratense
MAEDEEAASTLPGLSSSTL

SEQ ID NO: 282 - protein, 355 aa, Phleum pratense
VRVAVDVATMPALSETARSRGKDAGVSEKTSGAVEEMGFLGAGADADGFPWSNAMLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDSTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLM

SEQ ID NO: 283 - protein, 191 aa, Phleum pratense
AGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLMSIPRTVDLDEKTRTNLIQWPVEEIETLRINSTDLGGVTIDHGSVFPLPLRHATQLDIEA

SEQ ID NO: 284 - protein, 398 aa, Phleum pratense
GSRGKDAGVSEKTSGAVEEMGFLGAGADADGFPWSNAMLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDSTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLMSIPRTVDLDEKTRTNLIQWPVEEIETLRINSTDLGGVTIDHGSVFPLPLRHATQLDIEAA

SEQ ID NO: 285 - protein, 220 aa, Phleum pratense
KDFRDPTTAWFDDSDQTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLMSIPRTVDLDEKTRTNLIQWPVEEIETLRINSTDLGGVTIDHGSVFPLPLRHATQLDIE

SEQ ID NO: 286 - protein, 214 aa, Phleum pratense
LKDFRDPTTAWFDDSDQTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSERADVTKGWASLMSIPRTVDLDEKTRTNLIQWPVEEIETLRINSTDLGGVTIDHGSVFPLPLRH

SEQ ID NO: 287 - protein, 392 aa, Phleum pratense
GLKDFRDPTTAWFDDSDQTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLMSIPRTVDLDEKTRTNLIQWPVEEIETLRINSTDLGGVTIDHGSVFPLPLRHATQLDIEAAFRLDHAAVAALNEADVSYNCSTSGGSANRGALGPFGLLVLADGKEEQTAVYFYVSRGLDGALRTHFCHDESRSSRAKDVVKRVVGYTVPVLDGEAFSVRVLVDHSIVESFAMGGRSTATSRVYPTEAIYAAAGVYLFNNATSGTVTVEKLVVHEMDSSYNQIFMAEDL

SEQ ID NO: 288 - protein, 525 aa, Phleum pratense
QRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLMSIPRTVDLDEKTRTNLIQWPVEEIETLRINSTDLGGVTIDHGSVFPLPLRHATQLDIEAAFRLDHAAVAALNEADVSYNCSTSGGSANRGALGPFGLLVLADGKEEQTAVYFYVSRGLDGALRTHFCHDESRSSRAKDVVKRVVGYTVPVLDGEAFSVRVLVDHSIVESFAMGGRSTATSRVYPTEAIYAAAGVYLFNNATSGTVTVEKLVVHEMDSSYNQIFMAEDL

SEQ ID NO: 289 - protein, 375 aa, Phleum pratense
GGVRWRACAAVLAASAVVVLVVASGLAGSRVVRVAVDVATMPALSETARSRGKDAGVSEKTSGAVEEMGFLGAGADADGFPWSNAMLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAIPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSER

SEQ ID NO: 290 - protein, 315 aa, Phleum pratense
GAVEEMGFLGAGADADGFPWSNAMLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAIPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSERAD

SEQ ID NO: 291 - protein, 164 aa, Phleum pratense
GLKDFRDPTTAWFDDSDSTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLM

SEQ ID NO: 292 - protein, 346 aa, Phleum pratense
MPALSETARSRGKDAGVSEKTSGAVEEMGFLGAGADADGFPWSNAMLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDSTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSERADVTKGWASLM

SEQ ID NO: 293 - protein, 290 aa, Phleum pratense
MLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSER

SEQ ID NO: 294 - protein, 301 aa, Phleum pratense
MLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGNSGEELYVIKESSDDDRHDYYALGSYDAAANKWTPQDPEADLGIGLRYDWGKFYASKTFYDPAKKRRVLWGWIAETDSERADVTKGWASLM

SEQ ID NO: 295 - protein, 431 aa, Phleum pratense
SESTKIFLESSTMESRAIAGTPPLPYAYEPLPHSSDDAAHDDRRSGGVRWRACAAVLAASAVVVLVVASGLAGSRADRVAVDVATMPALSETARSRGKDAGVSEKTSGAVEEMGFLGAGADADGFPWSNAMLQWQRTGFHFQPEKNWMNDPNGPVFYRGWYHLFYQYNPEGAVWGNIAWGHAVSRDLIHWRHLPLAMVPDQWYDINGVWTGSATVFPDGSLNMLYTGSTNASVQVQCLAVPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSERADVTKGWASLM

SEQ ID NO: 296 - protein, 218 aa, Phleum pratense
TVFPDGSLNMLYTGSTNASVQVQCLAVPEDPNDSLLRNWTKHPANPVLLPPPGIGLKDFRDPTTAWFDDSDQTWRTVIGSKDDNGHAGIAMVYKTKDFVSYELIPGLLHRVDGTGMWECIDFYPVGGDSGEELYVIKESSDDDRHDYYALGSYDAAANKWTPQDPEADLGIGLRYDWGKFYASKTFYDPAKKRRVLWGWIAETDSERADVTKGWASLM

SEQ ID NO: 297 - protein, 133 aa, Phleum pratense
FVGDKVAYALAQGLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFLVGGASLKPEF

SEQ ID NO: 298 - protein, 116 aa, Phleum pratense
YALAQGLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFL

SEQ ID NO: 299 - protein, 143 aa, Phleum pratense
GDKVAYALAQGLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFLVGGASLKPEFIDIINAATVKSA

SEQ ID NO: 300 - protein, 195 aa, Phleum pratense
PLAVAVAMGRKFFVGGNWKCNGTTDQVDKIVKILNDGKIASTDIVEVVVSPPYVFLPTVKDKLRPEIQVAAQNCWVKKGGAFTGEVSAEMLANLGIPWVILGHSERRALLGESSEFVGDKVAYALAQGLKVIACVGETLEQREAGSTMTVVAEQTKAIADKITDWTNVVIAYEPVWAIGTGKVATPAQAQEVHAN

SEQ ID NO: 301 - protein, 161 aa, Phleum pratense
DGKIASTDIVEVVVSPPYVFLPTVKDKLRPEIQVAAQNCWVKKGGAFTGEVSAEMLANLGIPWVILGHSERRALLGESSEFVGDKVAYALAQGLKVIACVGETLEQREAGSTMTVVAEQTKAIADKITDWTNVVIAYEPVWAIGTGKVATPAQAQEVHANL

SEQ ID NO: 302 - protein, 240 aa, Phleum pratense
LAVAVAMGRKFFVGGNWKCNGTTDQVDKIVKILNDGKIASTDIVEVVVSPPYVFLPTVKDKLRPEIQVAAQNCWVKKGGAFTGEVSAEMLANLGIPWVILGHSERRALLGESSEFVGDKVAYALAQGLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFLVGG

SEQ ID NO: 303 - protein, 159 aa, Phleum pratense
MLANLGVPWDILGHSERRALLGESSEFVGDKVAYALAQGLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFLVGGASLKPEF

SEQ ID NO: 304 - protein, 178 aa, Phleum pratense
LSAEWNHRPVDKIVKILNDGKIASTDIVEVVVSPPYVFLPTVKDKLRPEIQVAAQNCWVKKGGAFTGEVSAEMLANLGVPWDILGHSERRALLGESSEFVGDKVAYALAQGLKVIACVGETLEQREAGSTMTVVAEQTKAIADKITDWTNVVIAYEPVWAIGTGKVATPAQAQEVHAN

SEQ ID NO: 305 - protein, 214 aa, Phleum pratense
LQKKKKKKFLPTVKDKLRPEIQVAAQNCWVKKGGAFTGEVSAEMLANLGVPWDILGHSERRALLGESSEFVGDKVAYALAQGLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFLVGGASLKPEFIDIINAATVKSA

SEQ ID NO: 306 - protein, 133 aa, Phleum pratense
GLKVIACVGETLEQREAGSTMTVVAEQTKAIADKITDWTNVVIAYEPVWAIGTGKVATPAQAQEVHANLRDWLKTNVSPEVAETTRIIYGGSVTGASANELAAQPDVDGFLVGGASLKPEFIDIINAATVKSA

SEQ ID NO: 307 - protein, 64 aa, Phleum pratense
GVWQHDRVEIIANDQGNRTTPSYVAFTDSERLIGDAAKNQVAMNPINTVFGEHLSTCTPYTTRS

SEQ ID NO: 308 - protein, 18 aa, Phleum pratense
SSTRGWCSRRRAGRGTSS

SEQ ID NO: 309 - protein, 107 aa, Phleum pratense
IPGPAEKPMIVVKYKGEEKQFAAEEISSMVLIKMREIAEAFLGNSIKNAVVTVPAYFNDSQRQATKDAGVIAGLNVLRIINEPTAAAIAYGLDKKSTSTGEKNVLIF

SEQ ID NO: 310 - protein, 235 aa, Phleum pratense
LDFVWYEPLTYNTEDEFAAHRAREFTLGWFMHPITYGHYPETMQRLVADRLPNFTDEQTRLLQGSADIVGVNHYTTYYAKNHENLTHMSYANDWQVQLVYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVIKNEE

SEQ ID NO: 311 - protein, 235 aa, Phleum pratense; identical to SEQ ID NO: 310

SEQ ID NO: 312 - protein, 80 aa, Phleum pratense
HALYDKFRIDYFDQYLHELKRATDDGARVTGYFAWSLLDNFEWRMGFTSKFGIVYVDRKTFTRYPKDSTRWFRKVIKNEE

SEQ ID NO: 313 - protein, 168 aa, Phleum pratense
IVGVNHYTTYYAKNHENLTHMSYANDWQVQLVYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVIKNEE

SEQ ID NO: 314 - protein, 206 aa, Phleum pratense
FMHPITYGHYPETMQRLVADRLPNFTDEQTRLLQGSADIVGVNHYTTYYAKNHENLTHMSYANDWQVQLVYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVIKNEE

SEQ ID NO: 315 - protein, 238 aa, Phleum pratense
GILLDFVWYEPLTYNTEDEFAAHRAREFTLGWFMHPITYGHYPETMQRLVADRLPNFTDEQTRLLQGSADIVGVNHYTTYYAKNHENLTHMSYANDWQVQLVYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVIKNEE

SEQ ID NO: 316 - protein, 137 aa, Phleum pratense
VYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVIKNEE

SEQ ID NO: 317 - protein, 137 aa, Phleum pratense; identical to SEQ ID NO: 316

SEQ ID NO: 318 - protein, 133 aa, Phleum pratense
VYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVI

SEQ ID NO: 319 - protein, 137 aa, Phleum pratense; identical to SEQ ID NO: 316

SEQ ID NO: 320 - protein, 81 aa, Phleum pratense
PHALYDKFRIDYFDQYLHELKRATDDGARVTGYFAWSLLDNFEWRMGFTSKFGIVYVDRKTFTRYPKDSTRWFRKVIKNEE

SEQ ID NO: 321 - protein, 63 aa, Phleum pratense
PHALYDKFRIDYFDQYLHELKRATDDGARVTGYFAWSLLDNFEWRMGFTSKFGIVYVDRKTFT

SEQ ID NO: 322 - protein, 80 aa, Phleum pratense; identical to SEQ ID NO: 312

SEQ ID NO: 323 - protein, 187 aa, Phleum pratense
DRLPNFTDEQTRLLQGSADIVGVNHYTTYYAKNHENLTHMSYANDWQVQLVYERNGIPIGKQGYSKWLYVVPWGFYKAVMHVKDKYRNPLMIIGENGIDQSGSDTLPHALYDKFRIDYFDQYLHELKRATDDGARVTGYFAWSLLDNFEWRMGFTSKFGIVYVDRKTFTRYPKDSTRWFRKVIKNEE

SEQ ID NO: 324 - protein, 187 aa, Phleum pratense; identical to SEQ ID NO: 323

SEQ ID NO: 325 - protein, 155 aa, Phleum pratense
GYDDIPKEVTDPDAKKPEDWDDEEDGEWTAPTIPNPEYKGPWKQKKIKNPNYQGKWNAPMTANPDFKDDPYIYAFDSLKYIGIELWQVKSGTLFDNILITDDAALAKTFAEETWAKHKDAEKAAFDEAEKKKEEEDASKAGEDDDDLDDEDADDE

SEQ ID NO: 326 - protein, 177 aa, Phleum pratense
GYDDIPKEVTDPDAKKPEDWDDEEDGEWTAPTIPNPEYKGPWKQKKIKNPNYQGKWKAPMIANPDFKDDPYIYAFDSLKYIGIELWQVKSGTLFDNILITDDAALAKTFAEETWAKHKDAEKAAFDEAEKKKEEEDASKAGEDDDDLDDEDADDEDKDDKAESDAEDHSDDEKHDEL

SEQ ID NO: 327 - protein, 177 aa, Phleum pratense; identical to SEQ ID NO: 326

SEQ ID NO: 328 - protein, 177 aa, Phleum pratense; identical to SEQ ID NO: 326

SEQ ID NO: 329 - protein, 132 aa, Phleum pratense
KIKNPNYQGKWKAPMIANPDFKDDPYIYAFDSLKYIGIELWQVKSGTLFDNILITDDAALAKTFAEETWAKHKDAEKAAFDEAEKKKEEEDASKAGEDDDDLDDEDADDEDKDDKAESDAEDHSDDEKHDEL

SEQ ID NO: 330 - protein, 171 aa, Phleum pratense
KEVTDPDAKKPEDWDDEEDGEWTAPTIPNPEYKGPWKQKKIKNPNYQGKWKAPMIANPDFKDDPYIYAFDSLKYIGIELWQVKSGTLFDNILITDDAALAKTFAEETWAKHKDAEKAAFDEAEKKKEEEDASKAGEDDDDLDDEDADDEDKDDKAESDAEDHSDDEKHDEL

SEQ ID NO: 331 - protein, 96 aa, Phleum pratense
MIANPDFKDDPYIYAFDSLKYIGIELWQVKSGTLFDNILITDDAALAKTFAEETWAKHKDAEKAAFDEAEKKKEEEDASKAGEDDDDLDDEDADDE

SEQ ID NO: 332 - protein, 96 aa, Phleum pratense; identical to SEQ ID NO: 331

SEQ ID NO: 333 - protein, 118 aa, Phleum pratense
MIANPDFKDDPYIYAFDSLKYIGIELWQVKSGTLFDNILITDDAALAKTFAEETWAKHKDAEKAAFDEAEKKKEEEDASKAGEDDDDLDDEDADDEDKDDKAESDAEDHSDDEKHDEL

SEQ ID NO: 334 - protein, 118 aa, Phleum pratense; identical to SEQ ID NO: 333

SEQ ID NO: 335 - protein, 19 aa, Phleum pratense
MARMKRPPRCCQDLVVLPL

SEQ ID NO: 336 - protein, 7 aa, Phleum pratense
MNNMSSR

SEQ ID NO: 337 - protein, 7 aa, Phleum pratense
MNNMSSR

SEQ ID NO: 338 - protein, 19 aa, Phleum pratense
MARMKRPPRCCQDLVVLPL

SEQ ID NO: 339 - protein, 19 aa, Phleum pratense
MARMKRPPRCCQDLVVLPL

SEQ ID NO: 340 - protein, 80 aa, Phleum pratense
QARGLLRRARGGPHHRRQRGAHRRVPLRPLRHRVRVHGQEGRRAKLRSAGEVEIQFRRVKCKYPEGTKVTFHVEKGSNPN

SEQ ID NO: 341 - protein, 81 aa, Phleum pratense
QARGLLRRARGGPHHRRQRGAHRRVPLRPLRHRVRVHGQEGRRAKLRSAGEVEIQFRRVKCKYPEGTKVTFHVVGVGPLLH

SEQ ID NO: 342 - protein, 86 aa, Phleum pratense
QARGLLRRARGGPHHRRQRGAHRRVPLRPLRHRVRVHGQEGRRAKLRSAGEVEIQFRRVKCKYPEGTKVTFHVEKGSNPNSTWGCW

SEQ ID NO: 343 - protein, 266 aa, Phleum pratense
TDAAAPAPAAAAASKWNLLTFDTEEDVAVSLAKYTAELSGKFAAERGAFTVVLSGGTLIETLRKLAEPPYLETVQWSKWHVFWVDERVVPKDHVDSNYKLAVDGLLSKVPIPTDQVYAINDTLSAEGAAADYETVLKQLVKSGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKPAVSMLQNK

SEQ ID NO: 344 - protein, 267 aa, Phleum pratense
ATDAAAPAPAAAAASKWNLLTFDTEEDVAVSLAKYTAELSGKFAAERGAFTVVLSGGTLIDTLRKLAEPPYLETVQWSKWHVFWVDERVVPKDHVDSNYKLAVDGLLSKVPIPTDQVYAINDTLSAEGAAADYETVLKQLVKSGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKPAVSMLQNK

SEQ ID NO: 345 - protein, 212 aa, Phleum pratense
GGTLIETLRKLAEPPYLETVQWSKWHVFWVDERVVPKDHVDSNYKLAVDGLLSKVPIPTDQVYAINDTLSAEGAAADYETVLKQLVKNGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKQAVSMLQNK

SEQ ID NO: 346 - protein, 256 aa, Phleum pratense
AAASKWNLLTFDTEEDVAVSLAKYTAELSGKFAAERGAFTVVLSGGTLIDTLRKLAEPPYLETVQWSKWHVFWVDERVVPKDHVDSNYKLAVDGLLSKVPIPTDQVYAINDTLSAEGAAADYETVLKQLVKNGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKQAVSMLQNK

SEQ ID NO: 347 - protein, 256 aa, Phleum pratense; identical to SEQ ID NO: 346

SEQ ID NO: 348 - protein, 256 aa, Phleum pratense
AAASKWNLLTFDTEEDVAVSLAKYTAELSGKFAAERGAFTVVLSGGTLIETLRKLAEPPYLETVQWSKWHVFWVDERVVPKDHVDSNYKLAVDGLLSKVPIPTDQVYAINDTLSAEGAAADYETVLKQLVKNGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKQAVSMLQNK

SEQ ID NO: 349 - protein, 256 aa, Phleum pratense
AAASKWNLLTFDTEEDVAVSLAKYTAELSGKFAAERGAFTVVLSGGTLIETLRKLAEPPYLETVQWSKWHVFWVDERVVPKDHVDSNYKLAVDGLLSKVPIPTDQVYAINDTLSAEGAAADYETVLKQLVKSGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKQAVSMLQNK

SEQ ID NO: 350 - protein, 256 aa, Phleum pratense
AAASKWNLLTFDTEEDVAVSLAKYTAELSGKFAAERGAFTVVLSGGTLIDTLRKLAEPPYLETVQWSKWHVFWVDERVVPKDHVDSNYKLAVDGLLSKVPIPTDQVYAINDTLSAEGAAADYETVLKQLVKSGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKQAVSMLQNK

SEQ ID NO: 351 - protein, 262 aa, Phleum pratense
TDAAAPAAASKWNLLTFDTEGDVAVSLAKYTAELSGKFAAERGAFTVVLSGGTLIDTLRKLAEPPYLETVQWSKWHVFWVDERVVPKDHVDSNYKLAVDGLLSKVPIPTDQVYAINDTLSAEGAAADYETVLKQLVKSGVLAMSTATGFPRFDLMLLGMGPDGHLASLFPGHPLLNENQKWVTHIMDSPKPPPQRITFTFPVIKSSAYVAMVVTGPGEASAVKKVLSDDKTLPLLPTEMAILQDGEFTWFTDKQAVSMLQNK

SEQ ID NO: 352 - protein, 194 aa, Phleum pratense
ATDAAAPAAASKWNLLTFDTEGDVAVSLAKYTAELSGKFAAERGAFTVVLSGGTLIDTLRKLAEPPYLETVQWSKWHVFWVDERVVPKDHVDSNYKLAVDGLLSKVPIPTDQVYAINDTLSAEGAAADYETVLKQLVKSGVLAMSTATGFPRFDLMLLGMGPDGHLASLFPGHPLLNENQKWVTHIMDSPKPPP

SEQ ID NO: 353 - protein, 395 aa, Phleum pratense
RAHIAFYQVCFEQKGCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGGGQCTSESVLKAQNITGKIIICEAGGGVSTAKAKMVLRAGAFGMIVVAPAVFGPVIVPRPHVLPTVQVPYAVGQKIKAYLEAESSPTANFIFKGTLFDTPRSPMMAPFSSRGPNVKSRGILKPDIIGPGVNVLAGVPGVVDMALQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHP

SEQ ID NO: 354 - protein, 526 aa, Phleum pratense
RAHIAFYQVCFEQKGCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGGGQCTSESVLKAQNITGKIIICEAGGGVSTAKAKMVLRAGAFGMIVVAPAVFGPVIVPRPHVLPTVQVPYAVGQKIKAYLEAESSPTANFIFKGTLFDTPRSPMMAPFSSRGPNVKSRGILKPDIIGPGVNVLAGVPGVVDMALQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIEGQLKWVSSKHIVRSPILILPGTGEEDTTEAAAPSAQP

SEQ ID NO: 355 - protein, 350 aa, Phleum pratense
FGMIVVAPAVFGPVIVPRPHVLPTVQVPYAVGQKIKAYLEAESSPTANFIFKGTLFDTPRSPTMAPFSSRGPNVKSRGILKPDIIGPGVNVLAGVPGVVDIVLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIEGQLKWVSSKHIVRSPILILPGTGEEDTTEAAAPSAQP

SEQ ID NO: 356 - protein, 237 aa, Phleum pratense
NKLIGARSFFESAKWKWKGLDDPVLPINEGQHGTHTSSTAAGAFVRGANISGNAVGTAAGMAPRAHIAFYQVCFEQKGCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGGGQCTSESVLKAQNITGKIIICEAGGGVSTAKAKMVLRA

SEQ ID NO: 357 - protein, 437 aa, Phleum pratense
TVGASTSDRRFAATVKLGSGLEVDGESLTEPKDYGKEMVPLVRDMGGGQCTSESVLKAQNITGKIIICEAGGGVSTAKAKMVLRAGAFGMIVVAPAVFGPVIVPRPHVLPTVQVPYAVGQKIKAYLEAESSPTANFIFKGTLFDTPRSPMMAPFSSRGPNVKSRGILKPDIIGPGVNVLAGVPGVVDIVLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIEGQLKWVSSKHIVRSPILILPGTGEEDTTEAAAPSAQP

SEQ ID NO: 358 - protein, 487 aa, Phleum pratense
HIAFYQVCFEQKGCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGDGQCTSESVLKAQNITGKIIICEAGGGVSTAKAKMVLRAGAFGMIVVAPAVFGPVIVPRPHVLPTVQVPYAVGQKIKAYLEAESSPTANFIFKGTLFDTPRSPTMAPFSSRGPNVKSRGILKPDIIGPGVNVLAGVPGVVDIVLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIE

SEQ ID NO: 359 - protein, 435 aa, Phleum pratense
GASTSDRRFAATVKLGSGLEVDGESLTEPKDYGKEMVPLVRDMGGGQCTSESVLKAQNITGKIIICEAGGGVSTAKAKMVLRAGAFGMIVVAPAVFGPVIVPRPHVLPTVQVPYAVGQKIKAYLEAESSPTANFIFKGTLFDTPRSPTMAPFSSRGPNVKSRGILKPDIIGPGVNVLAGVPGVVDMGLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVLDKADSVVNASRAVTNVGVASSTYDVEVEVPKSVTVEVHPPKLTFKALEEVLNYTVTVKTAAVPDGAIEGQLKWVSSKHIVRSPILILPGTGEEDTTEAAAPSAQP

SEQ ID NO: 360 - protein, 481 aa, Phleum pratense
GCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGDGQCTSESVLKAQNITGKIIICEAGGGVSTAKAKMVLGADAFGMIVVAPAVFGPVIVPRPHVLPTVQVPYAVGQKIKAYLEAESSPTANFIFKGTLFDTPRSPMMAPFSSRGPNVKSRGILKPDIIGPGVNVLAGVPGVVDIVLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIEGQLKWV

SEQ ID NO: 361 - protein, 512 aa, Phleum pratense
GCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGDGQCTSESVLKAQNITGKIIICEAGGGVSTAKAKMVLRAGAFGMIVVAPAVFGPVIVPRPHVLPTVQVPYAVGQKIKAYLEAESSPTANFIFKGTLFDTPRSPMMAPFSSRGPNVKSRGILKPDIIGPGVNVLAGVPGVVDIVLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIEGQLKWVSSKHIVRSPILILPGTGEEDTTEAAAPSAQP

SEQ ID NO: 362 - protein, 512 aa, Phleum pratense
GCDRDDILAAVDEAIEDGVDVLSLSLGGNPGADFSEDPVSLGGYTAALNGVFVSTAAGNIGPNPATLSNGAPWLLTVGASTSDRRFAATVKLGSGLEVDGESLTEPKDYGKEMVPLVRDMGGGQCTSESVLKAQNITGKIIICEAGGGVSTAKAKMVLGADAFGMIVVAPAVFGPVIVPRPHVLPTVQVPYAVGQKIKAYLEAESSPTANFIFKGTLFDTPRSPMMAPFSSRGPNVKSRGILKPDIIGPGVNVLAGVPGVVDIVLQPKEVMPKFDIKSGTSMSCPHLAGIAALLKNAHPTWSPASIKSALMTTTETTDNTKKPIADVDGTQATYFATGAGHVNPKKAMDPGLVYNLTAAEYIPYLCGLKYTDQQVNSIIHPEPPVTCDKLRKLDQKDLNYPSITVVVDKADSVVNASRAVTNVGVASSTYDVEVEVPKSVTVEVHPPKLTFKALEEVLNYTVTVKTAAVPDGAIEGQLKWVSSKHIVRSPILILPGTGEEDTTEAAAPSAQP

SEQ ID NO: 363 - protein, 81 aa, Phleum pratense
NNKLIGARSFFESAKWKWKGLDDPVLPINEGQHGTHTSSTAAGAFVRGANISGNAVGTAAGMAPRAHIAFYQVCFEQKGCD

SEQ ID NO: 364 - protein, 44 aa, Phleum pratense
PRSWSAVMLTFDNAGMWNVRSNVWERHYLGEQLYISVISPARSL

SEQ ID NO: 365 - protein, 57 aa, Phleum pratense
VSRHSIQVYPRSWSAVMLTFDNAGMWNVRSNVWERHYLGEQLYISVISPARSLRDEY

SEQ ID NO: 366 - protein, 55 aa, Phleum pratense
ELRKTYNLLDAVSRHSIQVYPRSWSAVMLTFDNAGMWNVRSNVWERHYLGEMTLM

SEQ ID NO: 367 - protein, 56 aa, Phleum pratense
ELRKTYNLLDAVSRHSIQVYPRSWSAVMLTFDNAGMWNVRSNVWERHYLAGEMTLM

SEQ ID NO: 368 - protein, 55 aa, Phleum pratense
ELRKTYNLLDAVSRHSIQVYPRSWSAVMLTFDNAGMWNVRSNVWERHYLGEQLYI

SEQ ID NO: 369 - protein, 52 aa, Phleum pratense
TYNLLDAVSRHSIQVYPRSWSAVMLTFDNAGMWNVRSNVWERHYLAGEMTLM

SEQ ID NO: 370 - protein, 239 aa, Phleum pratense
RGGFSGLFPDSSEYAFRTAVSSSMPGVVLFCDLKFSSDGVGFCIGNLRLDNTTLIDKDFASRGSTYQVNGQDVQGWFSLDFKSKELHEIPMIQNILSRSQIFDGIPNLMSLDNVVKIVDPNEIWVNVEYDSFYREHGLSSEDYILGLPKEFPVTWVSSPEVALLKSLAGKLRNSTKLIFRFLREDLVEPTTKMTYGELLKDLKSIKAFASGILVPKQFIWPMNKDMYLEPSTSLVKDAH

SEQ ID NO: 371 - protein, 88 aa, Phleum pratense
KIETELTKICEGILKLLETHLVPSSTAPESKVFYLKMKGDYHRYLAEFKSGAERKEAAESTMNSYKAAQDIALADLAPTHPIRLGLAL

SEQ ID NO: 372 - protein, 53 aa, Phleum pratense
GDYHRYLAEFKSGAERKEAAESTMNSYKAAQDIALADLAPTHPIRLGLALKIS

SEQ ID NO: 373 - protein, 90 aa, Phleum pratense
KDYRGKIETELTKICEGILKLLETHLVPSSTAPESKVFYLKMKGDYHRYLAEFKSGAERKEAAESTMNSYKAAQDIALADLAPTHPIRLG

SEQ ID NO: 374 - protein, 67 aa, Phleum pratense
SAGAAESKVFYLKMKGDYHRYLAEFKSGAERKEAAESTMNSYKAAQDIALADLAPTHPIRLGLALNF

SEQ ID NO: 375 - protein, 128 aa, Phleum pratense
VSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPNVGEVA

SEQ ID NO: 376 - protein, 374 aa, Phleum pratense
LLGLLAPLASAQLSREFYKASCPDAEKIVAAVIEKKLKEDPGPAAGLLRLLFHDCFANGCDASILIDPLSNQSAEKEAGPNISVRGFEVIDDIKKELEAKCPKTVSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPNVIDSSYFANVLAKKMPLTVDRLLGLDSKTTPIIKNMLNKPNDFMPTFAKAMEKLSVLKVITGKDGEIRKSCSEFNNPMPSTGGSVIRISSANPEDLEGLSSGGTQVAGIVSQGTKDPWHVKTLKAAGAAHPKKVTGRHPKLRGAHPQ

SEQ ID NO: 377 - protein, 374 aa, Phleum pratense
LLGLLAPLASAQLSREFYKASCPDAEKIVAAVIEKKLKEDPGTAAGLLRLLFHDCFANGCDASILIDPLSNQSAEKEAGPNISVRGFEVIDDIKKELEAKCPKTVSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPNVIDSSYFANVLAKKMPLTVDRLLGLDSKTTPIIKNMLNKPNDFMPTFAKAMEKLSVLKVITGKDGEIRKSCSEFNNPMPSTGGSVIRISSANPEDLEGLSSGGTQVAGIVSQGTKDPWHVKTLKAAGAAHPKKVTGRHPKLRGAHPQ

SEQ ID NO: 378 - protein, 65 aa, Phleum pratense
GCDASILIDPLSNQSAEKEAGPNISVRGFEVIDDIKKELEAKCPKTVSCADIVALGTRDAVRISG

SEQ ID NO: 379 - protein, 247 aa, Phleum pratense
PAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPNVIDSSYFANVLAKKMPLTVDRLLGLDSKTTPIIKNMLNKPNDFMPTFAKAMEKLSVLKVIAGKDGEIRKSCSEFNNPMPSTGGSVIRISSANPEDLEGLSSGGTQVAGIVSQGTKDPWHVKTLKAAGAAHPKKVTGRHPKLRGA

SEQ ID NO: 380 - protein, 374 aa, Phleum pratense
LLGLLAPLASAQLSREFYKASCPDAEKIVAAVIEKKLKEDPGTAAGLLRLLFHDCFANGCDASILIDPLSNQSAEKEAGPNISVRGFEVIDDIKKELEAKCPKTVSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPNVIDSSYFANVLAKKMPLTVDRLLGLDSKTTPIIKNMLNKPNDFMPTFAKAMEKLSVLKAIPGKDGEIRKSCSEFNNPMPSTGGSVIRISSANPEDLEGLSSGGTQVAGIVSQGTKDPWHVKTLKAAGAAHPKKVTGRHPKLRGAHPQ

SEQ ID NO: 381 - protein, 227 aa, Phleum pratense
LLGLLAPLASAQLSREFYKASCPDAEKIVAAVIEKKLKEDPGTAAGLLRLLFHDCFANGCDASILIDPLSNQSAEKEAGPNISVRGFEVIDDIKKELEAKCPKTVSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPN

SEQ ID NO: 382 - protein, 216 aa, Phleum pratense
KASCPDAEKIVAAVIEKKLKEDPGTAAGLLRLLFHDCFANGCDASILIDPLSNQSAEKEAGPNISVRGFEVIDDIKKELEAKCPKTVSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPNVIDSSYF

SEQ ID NO: 383 - protein, 177 aa, Phleum pratense
LFHDCFANGCDASILIDPLSNQSAEKEAGPNISVRGFEVIDDIKKELEAKCPKTVSCADIVALGTRDAVRISGGPAYEVPTGRRDSLVSNREEADNNLPGPDIPIPKLTSEFLSRGFTPEEMVVLLAGGHSIGKVRCIFIEPDATPMDPGYQASISKLCDGPNRDTGFVNMDEHNPN

SEQ ID NO: 384 - protein, 172 aa, Phleum pratense
WSEIQTLKPNLIGPFAAAGMDRNPVAKNAGKFMTLAGFLDYAKASNISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVL

SEQ ID NO: 385 - protein, 225 aa, Phleum pratense
IQTLKPNLIGPFAAAGMDRNPVAKNAGKFMTLAGFLDYAKASNISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYFSKWWYLLLDQKTV

SEQ ID NO: 386 - protein, 300 aa, Phleum pratense
EIQTLKPNLIGPFAAAGMDRNPVAKNAGKFMTLAGFLDYAKASNISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYFRSPCSDIKRNMSYTIKPGEPGALVDMAAYGALPPAPPPAPVLEPADVHRQPLPLCPTEPMFRTFRCRLPPKETGKNAEYTANLAADG

SEQ ID NO: 387 - protein, 301 aa, Phleum pratense
SEIQTLKPNLIGPFAAAGMDRNPVAKNAGKFMTLAGFLDYAKASNISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYFRSPCSDIKRNMSYTIKPGEPGALVDMAAYGALPPAPPPAPVLEPADVHRQPLPLCPTEPMFRTFRCRLPPKETGKNAEYTANLAADG

SEQ ID NO: 388 - protein, 214 aa, Phleum pratense
SEIQTLKPNLIGPFAAAGMDRNPVAKNAGKFMTLAGFLDYAKASNISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYF

SEQ ID NO: 389 - protein, 256 aa, Phleum pratense
ISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYFRSPCSDIKRNMSYTIKPGEPGALVDMAAYGALPPAPPPAPVLEPADVHRQPLPLCPTEPMFRTFRCRLPPKETGKNAEYTANLAADG

SEQ ID NO: 390 - protein, 247 aa, Phleum pratense
HAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYFRSPCSDIKRNMSYTIKPGEPGALVDMAAYGALPPAPPPAPVLEPADVHRQPLPLCPTEPMFRTFRCRLPPKETGKNAEYTANLAADG

SEQ ID NO: 391 - protein, 114 aa, Phleum pratense
LDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMS

SEQ ID NO: 392 - protein, 252 aa, Phleum pratense
WSEIQTLKPNLIGPFAAAGMDRNPVAKNAGKFMTLAGFLDYAKASNISGILIGIEHAAYLATRGLDVVDAVSNALIKSGYDKETKQQVFIQSEDPPVLSAFKKFPKFNRVFEIEFDIRDVSKPSVVEIKEFANAVKLRRSSAAQVDGFYLTGFNAVVERLRDADIQVHVGVLKNEFMSLAFDYWADPMVEIATDTWSVLADGLVTEFPSTAAAYFRSPCSDIKRNMSYTIKPGEPGALVDMAAYGALPPAPP

SEQ ID NO: 393 - protein, 77 aa, Phleum pratense
DGLPGTNCPVAPGTNFTYKWQPKDQIGSFFYFPSIGMQRTVGGYGLISVVSRLLIPVPFDPPADDLQVIIGDWYTKD

SEQ ID NO: 394 - protein, 145 aa, Phleum pratense
HVPLEEHVGTKTVLGVPQKVILINGEFPGPRINCSSNNNIVVNVFNQLDQPLLFTWNGIQHRKNSWQDGLPGTNCPVAPGTNFTYKWQPKDQIGSFFYFPSIGMQRTVGGYGLISVVSRLLIPVPFDPPADDLQVIIGDWYTKDH

SEQ ID NO: 395 - protein, 78 aa, Phleum pratense
DGLPGTNCPVAPGTNFTYKWQPKDQIGSFFYFPSIGMQRTVGGYGLISVVSRLLIPVPFDPPADDLQVIIGDWYTKDH

SEQ ID NO: 396 - protein, 53 aa, Phleum pratense
VAPGTNFTYKWQPKDQIGSFFYFPSIGMQRTVGGYGLISVVSRLLIPVPFDPP

SEQ ID NO: 397 - protein, 65 aa, Phleum pratense
TNFTYKWQPKDQIGSFFYFPSIGMQRTVGGYGLISVVSRLLIPVPFDPPADDLQVIIGDWYTKDH

SEQ ID NO: 398 - protein, 67 aa, Phleum pratense
TNFTYKWQPKDQIGSFFYFPSIGMQRTVGGYGLISVVSRLLIPVPFDPPADDLQVIIGDWYTKDHTV

SEQ ID NO: 399 - protein, 47 aa, Phleum pratense
PKFRRVLVIDPVISGASKPSIGEIKGFADAVMVSRGSLVRVNGFFLT

SEQ ID NO: 400 - protein, 56 aa, Phleum pratense
SVLSVFKKFPKFRRVLVIDPVISGASKPSIGEIKGFADAVMVSRGSLVRVNGFFLT

SEQ ID NO: 401 - protein, 64 aa, Phleum pratense
VFIQSDDSSVLSVFKKFPKFRRVLVIDPVISGASKPSIGEIKGFADAVMVSRGSLVRVNGFFPT

SEQ ID NO: 402 - protein, 56 aa, Phleum pratense
LNTESTEEFPKFRRVLVIDPVISGASKPSIGEIKGFADAVMVSRGSLVRVNGFFLT

SEQ ID NO: 403 - protein, 83 aa, Phleum pratense
QQVFIQSDDSSVLSVFKKFPKFRRVLVIDPVISGASKPSIGEIKGFADAVMVSRGSLVRVNGFFLTGFNDLVTEIHDANLSLH

SEQ ID NO: 404 - protein, 49 aa, Phleum pratense
TEEFPKFRRVLVIDPVISGASKPSIGEIKGFADAVMVSRGSLVRVNGFF

SEQ ID NO: 405 - protein, 37 aa, Phleum pratense
RQPGPLRGLNTKIASFLDPDGWKVVLVDHADFLKELH

SEQ ID NO: 406 - protein, 46 aa, Phleum pratense
TKELGGKILRQPGPLPGLNTKIASFLDPDGWKVVLVDHADFLKELH

SEQ ID NO: 407 - protein, 141 aa, Phleum pratense
ILQDNAKIVQIDSSIQARTVGAGSGGFSRLVCLRVHPTFTLLHPTEVVVAFTAINGSRQEVSPESGEVTLEGDLRPNGEWMLVDKCAGVSLVNRFEISQVSKCLVHWGTGDLNMELWSEERPVSKDTPLRICHQYELRQTS

SEQ ID NO: 408 - protein, 111 aa, Phleum pratense
VRTTDSRCMDLADPCSEYFVEAYLNNPLVQKAIHANTALNYPWTGCRTRTYNLRRFGDSPPSMLAHIKALVTTGIRIWLYSGELYAMVPVTASKHSWKKLRLEVVKDWRPW

SEQ ID NO: 409 - protein, 110 aa, Phleum pratense
DLADPCSEYFVEAYLNNPLVQKAIHANTALNYPWTGCRTRTYNLRRFGDSPPSMLPHLKALVTTGIRIWLYSGELYAMVPVTASKHSVEKLRLEVVKDWRPWSTAPGQDV

SEQ ID NO: 410 - protein, 64 aa, Phleum pratense
NPLVQKAIHANTALNYPWTGCRTRTYNLRRFGASPPSMLAHIKALVTTASASGCTAATWTRWCP

SEQ ID NO: 411 - protein, 64 aa, Phleum pratense
NPLVQKAIHANTALNYPWTGCRTRTYNLRRFGDSPPSMLAHIKALVTTASASGCTAATWTRWCP

SEQ ID NO: 412 - protein, 106 aa, Phleum pratense
NNPLVQKAIHANTALNYPWTGCRTRTYNLRRFGDSPPSMLAHIKALVTTGIRIWLYSGDLDAMVPVTASKHSVEKLRLEVVKDWRPWSTAPGQDVGGYVIEYKGLV

SEQ ID NO: 413 - protein, 65 aa, Phleum pratense
NNPLVQKAIHANTALNYPWTGCRTRTYNLRRFGDSPPSMLAHIKALVTTGIRSPLYSQMRMRWCP

SEQ ID NO: 414 - protein, 65 aa, Phleum pratense; identical to SEQ ID NO: 413

SEQ ID NO: 415 - protein, 76 aa, Phleum pratense
KVRTTDSRCMDLADPCSEYFVEAYLNNPLVQKAIHANTALNYPWTGCRTRTYNLRRFGDSPPSMLAHIKALVTTGI

SEQ ID NO: 416 - protein, 79 aa, Phleum pratense
AIHANTALNYPWTGCRTRTYNLRRFGDSPPSMLAHIKVLVTTGIRIWLYSGDLDAMVPVTASKHSVEKLRLEVVKDWRP

SEQ ID NO: 417 - protein, 66 aa, Phleum pratense
KAIHANTALNYPWTGCRTRTYNLRRFGDSPPSMLAHIKVLVTTGIRIWLYSGDLDAMVPVTASKHS

SEQ ID NO: 418 - protein, 59 aa, Phleum pratense
QKAIHANTALNYPWTGCRTRTYNLRRFGDSPPSMLAHIKALVTTGIRIWLYSGDLGAMV

SEQ ID NO: 419 - protein, 98 aa, Phleum pratense
QKAIHANTALNYPWTGCRTRTYNLRRFGDSPPSMLAHIKALVTTGIRIWLYSGDLGAMVPVTASKHSVEKLRLEVVKDWRPWSTAPGQDVGGYVIEYK

SEQ ID NO: 420 - protein, 130 aa, Phleum pratense
ACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 421 - protein, 270 aa, Phleum pratense
PHTASDSPHRADQPMAPRKFFVGGNWKCNGASDDVKKIATVLNEAEVPSEDAVEVVVSPPFVFLQQAKALLRPDFAVAAQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 422 - protein, 270 aa, Phleum pratense; identical to SEQ ID NO: 421

SEQ ID NO: 423 - protein, 271 aa, Phleum pratense
RPHTASDSPHRADQPMAPRKFFVGGNWKCNGTSDDVKKIVTVLNEAEVPSEDAVEVVVSPPFVFLQQAKALLRPDFAVAAQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 424 - protein, 256 aa, Phleum pratense
MAPRKFFVGGNWKCNGTSDDVKKIVTVLNEAEVPSEDAVEVVVSPPFVFLQQAKALLRPDFAVAAQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 425 - protein, 244 aa, Phleum pratense
MQNGTSDDVKKIVTVLNEAEVPSEDAVEVVVSPPFVFLQQAKALLRPDFAVAAQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 426 - protein, 271 aa, Phleum pratense
RPHTASDSPHRADQPMAPRKFFVGGNWKCNGASDDVKKIVTVLNEAEVPSEDAVEVVVSPPFVFLQQAKALLRPDFAVAAQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 427 - protein, 270 aa, Phleum pratense
PHTASDSPHRADQPMAPRKFFVGGNWKCNGASDDVKKIVTVLNEAEVPSEDAVEVVVSPPFVFLQQAKALLRPDFAVAAQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 428 - protein, 215 aa, Phleum pratense
VVSPPFVFLQQAKALLRPDFAVAGQNCWVRKGGAFTGEISAEMLVNLQVPWVILGHSERRALLSESNDFVADKVAYALAQGLKVIACIGETLEQREAGTTMEVVAAQTKAIAEKISDWTNVVLAYEPVWAIGTGKVASRAQAQEVHDGLRKWLHANVGPAVAESTRIIYGGSVNGANCKELAAQPDLDGFLVGGASLKPEFVDIIKSATVKSSSA

SEQ ID NO: 429 - protein, 173 aa, Phleum pratense
GGTVTREPGPVKGGKSVIAFIEDPDGYKFELIERGPTPEPLCQVMLRVGDLDRAIKFYEKAFGMELLRRKDNPQYKYTIAMMGYGPEDKNAVLELTYNYGVKEYDKGNAYAQIAIGTDDVYKTAEVVRQNGGQITREPGPLPGISTKITACTDPDGWKSVFVDNLDFLKELEE

SEQ ID NO: 430 - protein, 156 aa, Phleum pratense
IAFIEDPDGYKFELIERGPTPEPLCQVMLRVGDLDRAIKFYEKAFGMELLRRKDNPQYKYTIAMMGYGPEDKNAVLELTYNYGVKEYDKGNAYAQIAIGTDDVYKTAEVVRQNGGQITREPGPLPGISTKITACTDPDGWKSVFVDNLDFLKELEE

SEQ ID NO: 431 - protein, 156 aa, Phleum pratense; identical to SEQ ID NO: 430

SEQ ID NO: 432 - protein, 156 aa, Phleum pratense; identical to SEQ ID NO: 430

SEQ ID NO: 433 - protein, 231 aa, Phleum pratense
LGMKLLRKRDIPEERYTNAFLGYGPEDSHFVVELTYNYGVESYDIGSGFGHFGIAVEDVEKTVELIKAKGGTVTREPGPVKGGKSVIAFIEDPDGYKFELIERGPTPEPLCQVMLRVGDLDRAIKFYEKAFGMELLRRKDNPQYKYTIAMMGYGPEDKNAVLELTYNYGVKEYDKGNAYAQIAIGTDDVYKTAEVVRQNGGQITREPGPLPGISTKITACTDPAIWICAGS

SEQ ID NO: 434 - protein, 191 aa, Phleum pratense
FGIAVEDVEKTVELIKAKGGTVTREPGPVKGGKSVIAFIEDPDGYKFELIERGPTPEPLCQVMLRVGDLDRAIKFYEKAFGMELLRRKDNPQYKYTIAMMGYGPEDKNAVLELTYNYGVKEYDKGNAYAQIAIGTDDVYKTAEVVRQNGGQITREPGPLPGISTKITACTDPDGWKSVFVDNLDFLKELEE

SEQ ID NO: 435 - protein, 191 aa, Phleum pratense; identical to SEQ ID NO: 434

SEQ ID NO: 436 - protein, 101 aa, Phleum pratense
KSVIAFIEDPDGYKFELIERGPTPEPLCQVMLRVGDLDRAIKFYEKAFGMELLRRKDNPQYKYTIAMMGYGPEDKNAVLELTYNYGVKEYDKGNAYAQVDI

SEQ ID NO: 437 - protein, 36 aa, Phleum pratense
LQSKNCILYLCSIMICNCKVSKVLNTYIFLLYLEHT

SEQ ID NO: 438 - protein, 79 aa, Phleum pratense
QSKQMANPTTAAGVLRIFFHDCFVSGCDASVLIAPTHYAKSEKDADINHSLPGDAFDAVVRSKLALELECPGVVSCADI

SEQ ID NO: 439 - protein, 355 aa, Phleum pratense
PKSHTRVGSTYQPAAMRRLSLILLAAAALLAAAVSAEPGPAPKLSPDFYSQTCPRAERIIAEVVQSKQMANPTTAAGVLRVFFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTVGRIIELFTAKGFTVQEMVALSGAHTLGFSHCQEFASRIYNYRDKGGKPAPFDPSMNPTYAKGLQAACQDYQKDPTIAAFNDIMTPGKFDNIYSVNIERGLGLLSTDEDMWSDMRTKPFVQRYAANNTDFFEDFAKAIEKLSMYGVKTGADGEIRRRCDAFNSGPNIQ

SEQ ID NO: 440 - protein, 173 aa, Phleum pratense
MRRLSLLLLAAAALLAAAVSAEPGPAPKLSPDFYSQTCPRAERIIAEVVQSKQMANPTTAAGVLRVFFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTV

SEQ ID NO: 441 - protein, 64 aa, Phleum pratense
AAGVLRVFFHDCFVSGCDASVLIAPTHYAKSEKDADINHSLPGDAFDAVVRSKLALELECPGVV

SEQ ID NO: 442 - protein, 214 aa, Phleum pratense
PKSHTRVGSTYQPAAMRRLSLILLAAAALLAAAVSAEPGPAPKLSPDFYSQTCPRAERIIAEVVQSKQMANPTTAAGVLRVFFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTVGRIIELFTAKGFTVQEMVALSGAHTL

SEQ ID NO: 443 - protein, 214 aa, Phleum pratense; identical to SEQ ID NO: 442

SEQ ID NO: 444 - protein, 213 aa, Phleum pratense
PKSHTRVGSTYQPAAMRRLSLILLAAAALLAAAVSAEPGPAPKLSPDFYSQTCPRAERIIAEVVQSKQMANPTTAAGVLRVFFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTVGRIIELFTAKGFTVQEMVALSGAHT

SEQ ID NO: 445 - protein, 215 aa, Phleum pratense
PKSHTRVGSTYQPAAMRRLSLILLAAAALLAAAVSAEPGPAPKLSPDFYSQTCPRAERIIAEVVQSKQMANPTTAAGVLRVFFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTVGRIIELFTAKGFTVQEMVALSGAHTLG

SEQ ID NO: 446 - protein, 134 aa, Phleum pratense
FFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTVGRIIELFTAKGFTVQEMVALSGAHTLG

SEQ ID NO: 447 - protein, 279 aa, Phleum pratense
PKSHTRVGSTYQPAAMRRLSLILLAAAALLAAAVSAEPGPAPKLSPDFYSQTCPRAERIIAEVVQSKQMANPTTAAGVLRVFFHDCFVSGCDASVLIAPTHYAKSEKDADINHSLPGDAFDAVVRSKLALELECPGVVSCADILAIASRVLVTMTGGPRYPVPLGRKDSLSSNPAAPDVELPHSNFTVGRIIELFTAKGFTVQEMVALSGAHTLGFSHCQEFASRIYNYRDKGGKPAPFDPSMNPTYAKGLQAACQDYQKDPTIAAFNDIMSSSVLSSP

SEQ ID NO: 448 - protein, 127 aa, Phleum pratense
PHMLLILLLLHGANAALDEPVQKWQTLDGSPPLVIARGGFSGLFPESSLYAYQFAMSNGLPDVVLHCDLQLSSDGKGFCRSGLRLDKSTLIAEVFPKRDKTYKLGTEDIHGWFAVDFTAAELVNNVT

SEQ ID NO: 449 - protein, 132 aa, Phleum pratense
MGGRYPHMLLILLLLHGANAALDEPVQKWQTLDGSPPLVIARGGFSGLFPESSLYAYQFAMSNGLPDVVLHCDLQLSSDGKGFCRSGLRLDKSTLIAEVFPKRDKTYKLGTEDIHGWFAVDFTAAELVNNVT

SEQ ID NO: 450 - protein, 142 aa, Phleum pratense
MGGRYPHMLLILLLLHGANAALDEPVQKWQTLDGSPPLVIARGGFSGLFPESSLYAYQFAMSNGLPDVVLHCDLQLSSDGKGFCRSGLRLDKSTLIAEVFPKRDKTYKLGTEDIHGWFAVDFTAAELVNNVTGMHPKLSNLL

SEQ ID NO: 451 - protein, 132 aa, Phleum pratense; identical to SEQ ID NO: 449

SEQ ID NO: 452 - protein, 179 aa, Phleum pratense
HAANAGLGMLEPIKEEIPTISYSDLYQLAGVVAVEVSGGPVIPFHPGREDKPQPPPEGRLPDATKGSDHLRQVFGKQMGLSDQDIVALSGGHTLGRCHKERSGFEGPWTKNPLKFDNTYFTELLSGDKEGLIQLPSDKTLLTDPVFRPLVEKYAADEKAFFEDYKEAHLRLSELGYAEA

SEQ ID NO: 453 - protein, 180 aa, Phleum pratense
AHAANAGLGMLEPIKEEIPTISYSDLYQLAGVVAVEVSGGPVIPFHPGREDKPQPPPEGRLPDATKGSDHLRQVFGKQMGLSDQDIVALSGGHTLGRCHKERSGFEGPWTKNPLKFDNTYFTELLSGDKEGLIQLPSDKTLLTDPVFRPLVEKYAADEKAFFEDYKEAHLRLSELGYAEA

SEQ ID NO: 454 - protein, 90 aa, Phleum pratense
GGHTLGRCHKERSGFEGPWTKNPLKFDNTYFTELLSGDKEGLLQLPSDKTLLTDPVFRPLVEKYAADEKAFFEDYKEAHLRLSELGYAEA

SEQ ID NO: 455 - protein, 133 aa, Phleum pratense
HLQDKPQPPPEGRLPDATKGSDHLRQVFGKQMGLSDQDIVALSGGHTLGRCHKERSGFEGPWTKNPLKFDNTYFTELLSGDKEGLLQLPSDKTLLTDPVFRPLVEKYAADEKAFFEDYKEAHLRLSELGYAEA

SEQ ID NO: 456 - protein, 117 aa, Phleum pratense
PQEGVDHLRQVFGKQMGLSDQDIVALSGGHTLGRCHKERSGFEGPWTKNPLKFDNTYFTELLSGDKEGLIQLPSDKTLLTDPVFRPLVEKYAADEKAFFEDYKEAHLRLSELGYAEA

SEQ ID NO: 457 - protein, 117 aa, Phleum pratense; identical to SEQ ID NO: 456

SEQ ID NO: 458 - protein, 42 aa, Phleum pratense
RVQVVGPDGKRVLETRIEGGSLFIVPRFHVVSKIADASGMEW

SEQ ID NO: 459 - protein, 84 aa, Phleum pratense
KEVGLGADLVRIDAHSMCSPGFSCDSAYQVTYIVRGSGRVQVVGPDGKRVLETRIEGGSLFIVPRFHVVSKIADASGMEWFSII

SEQ ID NO: 460 - protein, 57 aa, Phleum pratense
RVQVVGPDGKRVLETRIEGGSLFIVPRFHVVSKIADASGMEWFSIITTPNPIFSHLA

SEQ ID NO: 461 - protein, 56 aa, Phleum pratense
YIVRGSGRVQVVGPDGKRVLETRIEGGSLFIVPRFHVVSKIADASGMEWFSIITTP

SEQ ID NO: 462 - protein, 58 aa, Phleum pratense
YQVTYIVRGSGRVQVVGPDGKRVLETRIEGGSLFIVPRFHVVSKIADASGMEWFSIIT

SEQ ID NO: 463 - protein, 50 aa, Phleum pratense
GSGRVQVVGPDGKRVLETRIEGGSLFIVPRFHVVSKIADASGMEWFSIIT

SEQ ID NO: 464 - protein, 67 aa, Phleum pratense
CDSAYQVTYIVRGSGRVQVVGPDGKRVLETRIEGGSLFIVPRFHVVSKIADASGMEWFSIITTPNPI

SEQ ID NO: 465 - protein, 75 aa, Phleum pratense
SMCSPGFSCDSAYQVTYIVRGSGRVQVVGPDGKRVLETRIEGGSLFIVPRFHVVSKIADASGMEWFSIITTPNPI

SEQ ID NO: 466 - protein, 113 aa, Phleum pratense
PGFSCDSAYQVTYIVRGSGRVQVVGPDGKRVLETRIEGGSLFIVPRFHVVSKIADASGMEWFSIITTPNPIFSHLAGKTSVWKAISPEVLEASFNTTPEMEKLFRSKRLDSEI

SEQ ID NO: 467 - protein, 70 aa, Phleum pratense
IDAHSMCSPGFSCDSAYQVTYIVRGSGRVQVVGPDGKRVLETRIEGGSLFIVPRFHVVSKIADASGMEWF

SEQ ID NO: 468 - protein, 48 aa, Phleum pratense
PPRSCRGRCPCSLRTPAWGSCSRMAPCNCRCPCSTRGARRRLPGRTSS

SEQ ID NO: 469 - protein, 121 aa, Phleum pratense
ATSPTTRTTAPTSRRSPSAPSPHTSPPPRASATTSSRDGTTRTCISTRRIPSRPTTSPWSTCRAARSPTPSATSASREPTPRPSRSSATSSRRSLDRREIWLSEMVAWVGLQLAFWIQWQH

SEQ ID NO: 470 - protein, 119 aa, Phleum pratense
SPTTRTTAPTSRRSPSAPSPHTSPPPRASATTSSRDGTTRTCISTRRIPSRPTTSPWSTCRAARSPTPSATSASREPTPRPSRSSDTSSRRSLDRREIWLSEMVAWVGLQLAFWIQWQH

SEQ ID NO: 471 - protein, 56 aa, Phleum pratense
SSCSRRCPWRPPRRWSCCPLPWPGTRRWWFRCHQPPSSRTAPGSSRSLYGSPSTSC

SEQ ID NO: 472 - protein, 56 aa, Phleum pratense; identical to SEQ ID NO: 471

SEQ ID NO: 473 - protein, 94 aa, Phleum pratense
VKVAPAALVNVLEARSALTISVLRISSMPFSVYHSGKSFSPPLPTQVWNPGSLAAFWGKRYPLLSAGRSYGATDSLEMMASSPGWTPCLANSLA

SEQ ID NO: 474 - protein, 44 aa, Phleum pratense
SSPSCAPESTHAVRALPSTHTARILLRSTTANVSGCKDRYERPS

SEQ ID NO: 475 - protein, 77 aa, Phleum pratense
QVQVPGGHQGDLPRGEGVQPQLPGAAGEVCRRRRRRGGGGHQGEGQGQVDRAQGVVGSHLEDRHSRQAHRPLHRPLH

SEQ ID NO: 476 - protein, 597 aa, Phleum pratense
FAAISNAKHLIYVTGWSVYTEITLLRDANRPKPAGGTVTLGELLKKKASEGVRVLMLVWDDRTSVGVLKKDGLMATHDEETMNYFQDTDVHCVLCPRDPDDSGSIVQDLQISTMFTHHQKIVVVDHDMPQPQSASRRRRIMSFVGGLDLCDGRYDTPFHSVFGTLDGAHHDDFHQPNFATSAITKGGPREPWHDIHCRLEGPVAWDVLYNFEQRWRKQGGKDLLIQLRDLADEIIPPSPVVYAEDREAWNVQLFRSIDGGAAFGFPDTPEDAARAGLVSGKDQIIDRSIQDAYICTIRRAKSFIYIENQYFLGSSYCWKPDGIKPDDVGALHLIPKELSMKVVSKIEAGERFTVYVVVPMWPEGIPASGSVQAILDWQRRTMEMMYTDIAQAIQAKGIDANPKDYLTFFCLGNREAKKAGEYEPPEPAEPDSDYLKAQQNRRFMIYVHTKMMIVDDEYIIVGSANINQRSMDGARDSEIAMGAYQPYHLAASRPARGQVHGFRMALWYEHLGMVDEAFQRPESVECVRKVNAMADRYWNLYAGDGPERDLPGHLLTYPVGVTSDGTVTQLPGVEFFPDTQARILGAKSDYLPPILTT

SEQ ID NO: 477 - protein, 424 aa, Phleum pratense
HQPNFATAAITKGGPREPWHDIHCRLEGPVAWDVLYNFEQRWRKQGGKDLLIQLRDLADEIIPPSPVVYAEDREAWNVQLFRSIDGGAAFGFPDTPEDAARAGLVSGKDQIIDRSIQDAYICAIRRAKSFIYIENQYFLGSSYCWKPDGIKPDDVGALHLIPKELSMKVVSKIEAGERFTVYVVVPMWPEGIPASGSVQAILDWQRRTMEMMYTDIAQAIQAKGIDANPKDYLTFFCLGNREAKKAGEYEPPEPAEPDSDYLKAQQNRRFMIYVHTKMMIVDDEYIIVGSANINQRSMDGARDSEIAMGAYQPYHLAASRPARGQVHGFRMALWYEHLGMVDEAFQRPESVECVRKVNAMADRYWNLYAGDGPERDLPGHLLTYPVGVTSDGTVTQLPGVEFFPDTQARILGAKSDYLPPILTT

SEQ ID NO: 478 - protein, 466 aa, Phleum pratense
QSASRRRRIMSFVGGLDLCDGRYDTPFHSVFGTLDGAHHDDFHQPNFATSAITKGGPREPWHDIHCRLEGPVAWDVLYNFEQRWRKQGGKDLLIQLRDLADEIIPPSPVVYAEDREAWNVQLFRSIDGGAAFGFPDTPEDAARAGLVSGKDQIIDRSIQDAYICAIRRAKSFIYIENQYFLGSSYCWKPDGIKPDDVGALHLIPKELSMKVVSKIEAGERFTVYVVVPMWPEGIPASGSVQAILDWQRRTMEMMYTDIAQAIQAKGIDANPKDYLTFFCLGNREAKKAGEYEPPEPAEPDSDYLKAQQNRRFMIYVHTKMMIVDDEYIIVGSANINQRSMDGARDSEIAMGAYQPYHLAASRPARGQVHGFRMALWYEHLGMVDEAFQRPESVECVRKVNAMADRYWNLYAGDGPERDLPGHLLTYPVGVTSDGTVTQLPGVEFFPDTQARILGAKSDYLPPILTT

SEQ ID NO: 479 - protein, 549 aa, Phleum pratense
SEGVRVLMLVWDDRTSVGVLKKDGLMATHDEETMNYFQDTDVHCVLCPRDPDDSGSIVQDLQISTMFTHHQKIVVVDHDMPQPQSASRRRRIMSFVGGLDLCDGRYDTPFHSVFGTLDGAHHDDFHQPNFATAAITKGGPREPWHDIHCRLEGPVAWDVLYNFEQRWRKQGGKDLLIQLRDLADEIIPPSPVLYAEDRETWNVQLFRSIDGGAAFGFPDTPEDAARAGLVSGKDQIIDRSIQDAYICAIRRAKSFIYIENQYFLGSSYCWKPDGIKPDDVGALHLIPKELSMKVVSKIEAGERFTVYVVVPMWPEGIPASGSVQAILDWQRRTMEMMYTDIAQAIQAKGIDANPKDYLTFFCLGNREAKKAGEYEPPEPAEPDSDYLKAQQNRRFMIYVHTKMMIVDDEYIIVGSANINQRSMDGARDSEIAMGAYQPYHLAASRPARGQVHGFRMALWYEHLGMVDEAFQRPESVECVRKVNAMADRYWNLYAGDGPERDLPGHLLTYPVGVTSDGTVTQLPGVEFFPDTQARILGAKSDYLPPILTT

SEQ ID NO: 480 - protein, 384 aa, Phleum pratense
TDVHCVLCPRDPDDSGSIVQDLQISTMFTHHQKIVVVDHDMPQPQSASRRRRIMSFVGGLDLCDGRYDTPFHSVFGTLDGAHHDDFHQPNFATAAITKGGPREPWHDIHCRLEGPVAWDVLYNFEQRWRKQGGKDLLIQLRDLADEIIPPSPVVYAEDREAWNVQLFRSIDGGAAFGFPDTPEDAARAGLVSGKDQIIDRSIQDAYICAIRRAKSFIYIENQYFLGSSYCWKPDGIKPDDVGALHLIPKELSMKVVSKIEAGERFTVYVVVPMWPEGIPASGSVQAILDWQRRTMEMMYTDIAQAIQAKGIDANPKDYLTFFCLGNREAKKAGEYEPPEPAEPDSDYLKAQQNRRFMIYVHTKMMIVDDEYIIVGSANINQRSM

SEQ ID NO: 481 - protein, 634 aa, Phleum pratense
PLLEGSGKLEVWCVDGSAKTALPKEDLGKFHSGDCYIVLYTYHSGEKREEFYLTYWIGKDSVLEDQHMALQIATTIWNSMKGRPVLGRIYQGKEPPQFIALFQPMVILKGGISSGYKKSIEENGLKDETYSGTGIALVHIHGTSIHNNKTLQVDAVSISLSSTDCFVLQSGNSMFTWIGNTSSYEQQQWAAKVAEFLKPGASVKHCKEGTESSAFWSALGGKQNYTSKNATQDVLREPHLYTFSFRNGKLEVTEVFNFSQDDLLTEDVMILDTHAEVFVWMGQCVDTKEKQTAFETGQKYVEHAVNFEGLSPDVPLYKVSEGNEPCFFRTYFSWDNTRSVIHGNSFQKKLSLLFGMRSESGSKGSGDGGPTQRASALAALSSAFNPSSQDKQSNDRPKSSGDGGPTQRASALAALSSSLNPSSKPKSPHSQSRSGQGSQRAAAVAALSNVLTAEGSTLSPRNDAEKTELAPSEFHTDQDAPGDEVPSEGERTEPDVSQEETANENGGETTFSYDRLISKSTDPVRGIDYKRRETYLSDSEFETVFGVTKGGILPAAKVEARIAEKKSRSFLKHSLLRTQRLHKFLVCSSMIGVMAHQKPMSGNLVMFQMQDHQLIYPLISPSFLVYSFFVHDLR

SEQ ID NO: 482 - protein, 571 aa, Phleum pratense
PPLLEGSGKLEVWCVDGSAKTALPKEDLGKFHSGDCYIVLYTYHSGEKREEFYLTYWIGKDSVLEDQHMALQIATTIWNSMKGRPVLGRIYQGKEPPQFIALFQPMVILKGGISSGYKKSIEENGLKDETYSGTGIALVHIHGTSIHNNKTLQVDAVSISLSSTDCFVLQSGNSMFTWIGNTSSYEQQQWAAKVAEFLKPGASVKHCKEGTESSAFWSALGGKQNYTSKNATQDVLREPHLYTFSFRNGKLEVTEVFNFSQDDLLTEDVMILDTHAEVFVWMGQCVDTKEKQTAFETGQKYVEHAVNFEGLSPDVPLYKVSEGNEPCFFRTYFSWDNTRSVIHGNSFQKKLSLLFGMRSESGSKGSGDGGPTQRASALAALSSAFNPSSQDKQSNDRPKSSGDGGPTQRASALAALSSSLNPSSKPKSPHSQSRSGQGSQRAAAVAALSNVLTAEGSTLSPRNDAEKTELAPSEFHTDQDAPGDEVPSEGERTEPDVSQEETANENGGETTFSYDRLISKSTDPVRGIDYKRRETYLSDSEFETVFGVTKEEFYQQPRWKQELQKRKADLF

SEQ ID NO: 483 - protein, 663 aa, Phleum pratense
VGRVTQVDDRKAASAAVEEFIVKQNRPKTTRVTQVIQGYENHTFKSLFESWPVSSTGNASTEEGRGKVAALLKKKGDVKGASKNSTPVNEEVPPLLEGSGKLEVWCVDGSAKTALPKEDLGKFHSGDCYIVLYTYHSGEKREEFYLTYWIGKDSVLEDQHMALQIATTIWNSMKGRPVLGRIYQGKEPPQFIALFQPMVILKGGISSGYKKSIEENGLKDETYSGTGIALVHIHGTSIHNNKTLQVDAVSISLSSTDCFVLQSGNSMFTWIGNTSSYEQQQWAAKVAEFLKPGASVKHCKEGTESSAFWSALGGKQNYTSKNATQDVLREPHLYTFSFRNGKLEVTEVFNFSQDDLLTEDVMILDTHAEVFVWMGQCVDTKEKQTAFETGQKYVEHAVNFEGLSPDVPLYKVSEGNEPCFFRTYFSWDNTRSVIHGNSFQKKLSLLFGMRSESGSKGSGDGGPTQRASALAALSSAFNPSSQDKQSNDRPKSSGDGGPTQRASALAALSSSLNPSSKPKSPHSQSRSGQGSQRAAAVAALSNVLTAEGSTLSPRNDAEKTELAPSEFHTDQDAPGDEVPSEGERTEPDVSQEETANENGGETTFSYDRLISKSTDPVRGIDYKRRETYLSDSEFETVFGVTKEEFYQQPRWKQELQKRKADLF

SEQ ID NO: 484 - protein, 663 aa, Phleum pratense; identical to SEQ ID NO: 483

SEQ ID NO: 485 - protein, 43 aa, Phleum pratense
DYKRRETYLSDSEFQTVFGVTKEEFYQQPRWKQELQKRKADLF

SEQ ID NO: 486 - protein, 508 aa, Phleum pratense
LEDQHMALQIATTIWNSMKGRPVLGRIYQGKEPPQFIGLFQPMVILKGGISSGYKKSIEENGLKDETYSGTGIALVHIHGTSIHNNKTLQVDAVSISLSSTDCFVLQSGNSMFTWIGNTSSYEQQQWAAKVAEFLKPGASVKHCKEGTESSAFWSALGGKQNYTSKNATQDVLREPHLYTFSFRNGKLEVTEVFNFSQDDLLTEDVMILDTHAEVFVWMGQCVDTKEKQTAFETGQKYVEHAVNFEGLSPDVPLYKVSEGNEPCFFRTYFSWDNTRSVIHGNSFQKKLSLLFGMRSESGSKGSGDGGPTQRASALAALSSAFNPSSQDKQSNDRPKSSGDGGPTQRASALAALSSSLNPSSKPKSPHSQSRSGQGSQRAAAVAALSNVLTAEGSTLSPRNDAEKTELAPSEFHTDQDAPGDEVPSEGERTEPDVSQEETANENGGETTFSYDRLISKSTDPVRGIDYKRRETYLSDSEFETVFGVTKEEFYQQPRWKQELQKRKADLF

SEQ ID NO: 487 - protein, 43 aa, Phleum pratense
ITNAERLIYQTANSRLCSVLPKEEFYQQPRWKQELQKRKADLF

SEQ ID NO: 488 - protein, 24 aa, Phleum pratense
ATGAAAAMTTTIRSTATARPRAIV

SEQ ID NO: 489 - protein, 107 aa, Phleum pratense
RVRREYKANEISEEAYVSAIKEEISKVVKIQEELDIDVLVHGEPERNDMVEYFGEQLSGFAFTANGWVQSYGSRCVKPPIIYGDVSRPNPMTVFWSKMAQSMTPRPM

SEQ ID NO: 490 - protein, 191 aa, Phleum pratense
IAIAFLSVSNNYEYILSDKLVVSTSCSLMHTAVDLVNETKLDSEIKSWLAFAAQKVVEVNALGKALVGLKDEAYFAANAAAQASRRSSPRVNNEEVQKAAAALKGSDHRRATTVSARLDAQQKKLNLPVLPTTTIGSFPQTMDLRRVRREYKAKKISEEAYVSAIKEEISKVVKIQEELDIDVLVHGEPER

SEQ ID NO: 491 - protein, 268 aa, Phleum pratense
YLFAGVVDGRNIWADDLAASLSTLESLEAIVGKDKLVVSTSCSLMHTAVDLVNETKLDSEIKSWLAFAAQKVVEVNALGKALVGLKDEAYFAANAAAQASRRSSPRVNNEEVQKAAAALKGSDHRRATTVSARLDAQQKKLNLPVLPTTTIGSFPQTMDLRRVRREYKAKKISEEAYVSAIKEEISKVVKIQEELDIDVLVHGEPERNDMVEYFGEQLSGFAFTANGWVQSYGSRCVKPPIIYGDVSRPNPMTVFWSKMAQSMTPRPM

SEQ ID NO: 492 - protein, 230 aa, Phleum pratense
KVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSFNLVKEIRKRKGLKEQMTPLSDFEDKL

SEQ ID NO: 493 - protein, 185 aa, Phleum pratense
EIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSFNLVKEIRKRKGLKEQMTPLSDFEDKL

SEQ ID NO: 494 - protein, 344 aa, Phleum pratense
NQPKLVEGLKRLAKSDPMVLCSIEESGEHIIAGAGELHLEICLKDLQDDFMGGAEIIVSPPVVSFRETVLDKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSFNLVKEIRKRKGLKEQMTPLSDFEDKL

SEQ ID NO: 495 - protein, 237 aa, Phleum pratense
IGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSFNLVKEIRKRKGLKEQMTPLSDFEDKL

SEQ ID NO: 496 - protein, 238 aa, Phleum pratense
RIGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSFNLVKEIRKRKGLKEQMTPLSDFEDKL

SEQ ID NO: 497 - protein, 238 aa, Phleum pratense
RIGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSANLVKEIRKRKGLKEQMTPLSDFEDKL

SEQ ID NO: 498 - protein, 204 aa, Phleum pratense
ETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSSNLVKEIRKRKGLKEQMTPLSDFEDKL

SEQ ID NO: 499 - protein, 473 aa, Phleum pratense
DPEGPLMLYVSKMIPASDKGRFFAFGRVFAGRVATGMKVRIMGPNFVPGQKKDLYTKSVQRTVIWMGKKQESVEDVPCGNTVALVGLDQFITKNATLTGEKEVDACPIRAMKFSVSPVVRVAVQCKVASDLPKLVEGLKRLAKSDPMVLCSIEESGEHIIAGAGELHLEICLKDLQDDFMGGAEIIVSPPVVSFRETVLDKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEVDSQSFNLVKEIRKRKGLKEQMTPLSDFEDKL

SEQ ID NO: 500 - protein, 455 aa, Phleum pratense
DPEGPLMLYVSKMIPASDKGRFFAFGRVFAGRVATGMKVRIMGPNFVPGQKKDLYTKSVQRTVIWMGKKQESVEDVPCGNTVALVGLDQFITKNATLTGEKEVDACPIRAMKFSVSPVVRVAVQCKVASDLPKLVEGLKRLAKSDPMVLCSIEESGEHIIAGAGELHLEICLKDLQDDFMGGAEIIVSPPVVSFRETVLDKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEADSQSANLVKEIRK

SEQ ID NO: 501 - protein, 178 aa, Phleum pratense
AGFQWASKEGALADENMRGICFEVCDVVLHTDAIHRGGGQVIPTARRVIFASQLTAKPRLLEPVYLVEIQAPEGALGGIYGVLNQKRGHVFEEMQRPGTPLYNIKAYLPVIESFGFSATLRAATSGQAFPQCVFDHWDVMNSDPLEADSQSANLVKEIRKRKGLKEQMTPLSDFEDKL

SEQ ID NO: 502 - protein, 114 aa, Phleum pratense
RHLARQFIPHLHQRFIHPPIHQPNTMENLSSTIFSFVILLSASASLVVAGDPIKEACGGTRFPETCASVLSANKDPRSTYADPGELAEMEVSAAFHLFSMAVTTTRSQQWNDEN

SEQ ID NO: 503 - protein, 92 aa, Phleum pratense
RHLARQFIPHLHQRFIHPPIHQPNTMENLSSTIFSFVILLSASASLVVAGDPIKEACGGTRFPETCASVLSANKDPRSTYADPVELAEMEVS

SEQ ID NO: 504 - protein, 55 aa, Phleum pratense
PNTMENLSSTIFSFVILLSASASLVVAGDPIKEACRGTRFPETCASVLSANKDPR

SEQ ID NO: 505 - protein, 44 aa, Phleum pratense
YYGKINLSKVRTFLTEAKAKHIEWNCDVCRRGDDKKKVDEISKG

SEQ ID NO: 506 - protein, 76 aa, Phleum pratense
PHVARIRPHLHQRFIHPPIHQPNTMENLSSTIFSFVILLSASASLVVAGDPIKEACGGTRFPETCASVLSANKDPR

SEQ ID NO: 507 - protein, 57 aa, Phleum pratense
MENLSSTIFSFVILLSASASLVVAGDPIKEACGGTRFPETCASVLSANKDPRSAYVD

SEQ ID NO: 508 - protein, 58 aa, Phleum pratense
MENLSSTIFSFVILLSASASLVVAGDPIKEACGGTRFPETCASVLSANKDPRSTYADP

SEQ ID NO: 509 - protein, 54 aa, Phleum pratense
FTPHSLKLHKACEAFNPYDGKISLSKVRSFLTEAKAKHIEWNCDVCRHGDDKKK

SEQ ID NO: 510 - protein, 69 aa, Phleum pratense
QQWNDENMSKEDEDCFKECGVKLHKACEAFNPYDGKISLSKVRSFLTEAKAKHIEWNCDVCRHGDDKKK

SEQ ID NO: 511 - protein, 55 aa, Phleum pratense
FTPHSLKLHKACEAFDPYYGKISLSKVRSFLTEAKAKHIEWNCDVCRHGDDKKKV

SEQ ID NO: 512 - protein, 70 aa, Phleum pratense
QQWNDENMSKEDEDCFKECGVKLHKACEAFDPYYGKISLSKVRSFLTEAKAKHIEWNCDVCRHGDDKKKV

SEQ ID NO: 513 - protein, 91 aa, Phleum pratense
NTMENLSSTIFSFVILLSASASLVVAGDQIKEACGGTRFPETCASVLSANKDPRSTYADPVELAEMEVSAAFHLFSMAVTAARSQQWNDEN

SEQ ID NO: 514 - protein, 72 aa, Phleum pratense
SQQWNDENMSKEDEDCFKECGVKLHKACEAFDPYDGKISLSKVRSFLTEAKAKHIEWNCDVCRHGDDKKKVD

SEQ ID NO: 515 - protein, 89 aa, Phleum pratense
MENLSSTIFSFVILLSASASLVVAGDPIKEACGGTRFPETCASVLSANKDPRSTYADPVELAEMEVSAAFHLFSMAVTAARSQQWNDEN

SEQ ID NO: 516 - protein, 62 aa, Phleum pratense
QQWNDENMSKEDEDCFKECGVKLHKACEAFNPYDGKISLSKVRSFLAEAKAKHIEWNCDVCR

SEQ ID NO: 517 - protein, 92 aa, Phleum pratense
LLSASASLVVAGDPIKEACGGTRFPETCASVLSANKDPRSTYADPGELAEMECGTDFHLFSMTVTAAGSQQWNDENMSKEDEDCFKECGVKL

SEQ ID NO: 518 - protein, 77 aa, Phleum pratense
GSQQWNDENMSKEDEDCFKECGVKLHKACDAFNPYYGKTNLSKVRTFLTEAKAKHIEWNCDVCRHGDDKKTVDEISK

SEQ ID NO: 519 - protein, 66 aa, Phleum pratense
DGGREILHQPNTMENLSSTIFSFVILLSASASLVVAGDPIKEACGGTRYPETCVSVLSANKDPRST

SEQ ID NO: 520 - protein, 112 aa, Phleum pratense
IKEACGGTRFPETCASVLSANKDPRSTYADPVELAEMEVSAAFHLFSMAVTAARSQQWNDENMSKEKRWNAALTSISASSTGSAYVDLGSLLAERTEACASGKRVPPHASLI

SEQ ID NO: 521 - protein, 83 aa, Phleum pratense
IKEACGGTRFPETCASVLSANKDPRSTYADPVELAEMEVSAAFHLFSMAVTAARSQQWNDENMSKEDEDCFKECGVKLHTLDR

SEQ ID NO: 522 - protein, 87 aa, Phleum pratense
IKEACGGTRFPETCASVLSANKDPRSTYADPVELAEMEVSAAFHLFSMAVTAARSQQWNDENMSKEDEDCFKECGVKLHKACEAFNP

SEQ ID NO: 523 - protein, 51 aa, Phleum pratense
STIFSFVILLSASASLVVAGDPIKEACGGPRFPETCASVLSANKDPRSTYA

SEQ ID NO: 524 - protein, 78 aa, Phleum pratense
IKEACGGTRFPETCASVLSANKDPRSTYADPVELAEMEVSAAFHLFSMAVTAARSQQWNDENMSKEDEDCFKECGVKL

SEQ ID NO: 525 - protein, 87 aa, Phleum pratense
IKEACGGTRFPETCASVLSANKDPRSTYADPVELAEMEVSAAFHLFSMAVTAARSQQWNDENMSKEDEDCFKECGMKLHKACEAFNP

SEQ ID NO: 526 - protein, 82 aa, Phleum pratense
IKEACGGTRFPETCASVLSANKDPRSTYADPVELAEMEVSAAFHLFSMAVTAARSQQWNDENMSKEDEDCFKECGLNASHAL

SEQ ID NO: 527 - protein, 65 aa, Phleum pratense
RAAVTTMENLSSTIFSFVILLSASASLVVAGDPIKEACGGTRFPETCASVLSANKDPRSAYVDLG

SEQ ID NO: 528 - protein, 76 aa, Phleum pratense
VKLKNVLNVYEARLTKFKYLAGDYLSLADLNHVSTTLCLGATPHASLFDAYPHVKAWWTDLLAKPSVQKVAALMKP

SEQ ID NO: 529 - protein, 81 aa, Phleum pratense
VEDNLVKLKNVLNVYEARLTKSKYLAGDYLSLADLNHVSTTLCLGATPHASLFDAYPHVKAWWTDLLAKPSVQKVAALMKP

SEQ ID NO: 530 - protein, 70 aa, Phleum pratense
LKKVLEVYEARLTKFKYLAGDYLSLADLNHVSTTLCLGATPHASLFDAYPHVKAWWTDLLAKPSVQKVAA

SEQ ID NO: 531 - protein, 48 aa, Phleum pratense
DLNHVSTTLCLGATPHASLFDAYPHVKAWWTDLLAKPSVQKVAALMKP

SEQ ID NO: 532 - protein, 79 aa, Phleum pratense
DNLVKLKNVLNVYEARLTKSKYLAGDYLSLADLNHVSTTLCLGATPHASLFDAYPHVKAWWTDLLAKPSVQKVAALMKP

SEQ ID NO: 533 - protein, 73 aa, Phleum pratense
KKVLEVYEARLTKFKYLAGDYLSLADLNHVSTTLCLGATPHASLFDAYPHVKAWWTDLLAKPSVQKVAALMKP

SEQ ID NO: 534 - protein, 108 aa, Phleum pratense
QYTAALSPILFECLIHPMLGGATNQKVVEDNLVKLKNVLNVYEARLTKSKYLAGDYLSLADLNHVSTTLCLGATPHASLFDAYPHVKAWWTDLLAKPSVQKVAALMKP

SEQ ID NO: 535 - protein, 108 aa, Phleum pratense
QYTAALSPILFECLIHPMLGGATNQKVIEDNLVKLKNVLNVYEARLTKSKYLAGDYLSLADLNHVSTTLCLGATPHASLFDAYPHVKAWWTDLLAKPSVQKVAALMKP

SEQ ID NO: 536 - protein, 108 aa, Phleum pratense
QYTAALSPILFECLIHPMLGGATNQKVVEDNLVKLKNVLNVYEARLTKFKYLAGDYLSLADLNHVSTTLCLGATPHASLFDAYPHVKAWWTDLLAKPSVQKVAALMKP

SEQ ID NO: 537 - protein, 83 aa, Phleum pratense
AALEEAGVDYEIVPINFGTGEHKAPDHLARNPFGQVPALQDGDLCIFESRAICKYACRKNKPELLKEGDLKEAAMDEALEENG

SEQ ID NO: 538 - protein, 62 aa, Phleum pratense
DHLARNPFGQVPALQDGDLCIFESRAICKYACRKNKPELLKEGDLKESAMVDVWLEVEANQY

SEQ ID NO: 539 - protein, 166 aa, Phleum pratense
CIPYRESAGGEVEVLVISSRKKGASAGVLFPKGGWELDETMEEAARREALEEAGVDYEIVPINFGTGEHKGPDHLARNPFGQVPALQDGDLCIFESRAICKYACRKNKPELLKEGDLKESAMVDVWLEVEAQQYTAALSPILFECLVHPMLGGATDQKVVEDNLLQ

SEQ ID NO: 540 - protein, 21 aa, Phleum pratense
KLRFTCLSSTGSSCLFVLILF

SEQ ID NO: 541 - protein, 79 aa, Phleum pratense
EKLKKVLEVYEARLSKHSYLAGDFVSFADLNHFPKTFYFMATPHASLFDSYPHVKAWWERIMARPAVKKIAAAMVPPKA

SEQ ID NO: 542 - protein, 46 aa, Phleum pratense
PDHLARNPFGQVPALQDGDLYIFESRAICKYACRKNKPELLKEGDL

SEQ ID NO: 543 - protein, 95 aa, Phleum pratense
LEEAGVDYEIVPINFGTGEHKGPDHLARNPFGQVPALQDGDLYIFESRAICKYACRKNKPELLKEGDLKEAAMVDVWLEVEANQYTAALGPILFE

SEQ ID NO: 544 - protein, 164 aa, Phleum pratense
PAPRRLFKPGPPASSSPSHPIHPAATSLPPPRKRKVRGFWRVHQISARMAPVKLYGATLSWNVTRCVAALEEAGVDYEIVPINFGTGEHKGPDHLARNPFGQVPALQDGDLYIFESRAICKYACRKNKPELLKEGDLKESAMVDVWLEVEANQYTAALGPILFE

SEQ ID NO: 545 - protein, 419 aa, Phleum pratense
RLKKLKSEHGKVQLGNITVDMVLGGMRGMTGMLWETSLLDPEEGIRFRGLSIPECQKVLPTAVKGGEPLPEGLLWLLLTGKVPTKEQVDALSKDLLSRSTVPGYVYKAIDALPVTAHPMTQFTTGVMALQVESEFAKAYDKGMPKSKFWEPTYEDCLNLIARLPQVASYVYRRIFKDGKTIAADNSLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGVLRNTDPRYSCQREFALKHLPEDPLFQLVSKLYEVVPGILTELGKVKNPWPNVDAHSGVLLNHFGLVEARYDTVLFGVSRSMGIGSQLIWDRALGLPLERPKSVTMEWLENHCKKVAA

SEQ ID NO: 546 - protein, 419 aa, Phleum pratense
RLKKLKSEHGKVQLGNITVDMVLGGMRGMTGMLWETSLLDPEEGIRFRGLSIPECQKVLPTAVKGGEPLPEGLLWLLLTGKVPTKEQVDALSKDLLSRSTVPGYVYKAIDALPVTAHPMTQFTTGVMALQVESEFAKAYDKGMPKSKFWEPTYEDCLNLIARLPQVASYVYRRIFKDGKTIAADNSLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGALRDTDPRYSCQREFALKHLPEDPLFQLVSKLYEVVPGILTELGKVKNPWPNVDAHSGVLLNHFGLVEARYHTVLFGVSRSMGIGSQLIWDRALGLPLERPKSVTMEWLGNHCKKVAA

SEQ ID NO: 547 - protein, 445 aa, Phleum pratense
AYFEACSLFLNYAVSFNYFVCNLLQERLKKLKSEHGKVQLGNITVDMVLGGMRGMTGMLWETSLLDPEEGIRFRGLSIPECQKVLPTAVKGGEPLPEGLLWLLLTGKVPTKEQVDALSKDLLSRSTVPGYVYKAIDALPVTAHPMTQFTTGVMALQVESEFAKAYDKGMPKSKFWEPTYEDCLNLIARLPQVASYVYRRIFKDGKTIAADNSLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGALRDTDPRYSCQREFALKHLPEDPLFQLVSKLYEVVPGILTELGKVKNPWPNVDAHSGVLLNHFGLVEARYDTVLFGVSRSMGIGSQLIWDRALGLPLERPKSVTMEWLENHCKKVAA

SEQ ID NO: 548 - protein, 444 aa, Phleum pratense
AYFEACSLFLNYAVSFNYFVCNLLQERLKKLKSEHGKVQLGNITVDMVLGGMRGMTGMLWETSLLDPEEGIRFRGLSIPECQKVLPTAVKGGEPLPEGLLWLLLTGKVPTKEQVDALSKDLLSRSTVPGYVYKAIDALPVTAHPMTQFTTGVMALQVESEFAKAYDKGMPKSKFWEPTYEDCLNLIARLPQVASYVYRRIFKDGKTIAADNSLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGALRDTDPRYSCQREFALKHLPEDPLFQLVSKLYEVVPGILTELGKVKNPWPNVDAHSGVLLNHFGLVEARYDTVLFGVSRSMGIGSQLIWDRALGLPLERPKSVTMEWLGNHCKKGA

SEQ ID NO: 549 - protein, 89 aa, Phleum pratense
VSKLYEVVPGILTELGKVKNPWPNVDAHSGVLLNHFGLVEARYDTVLFGVSRSMGIGSQLIWDRALGLPLERPKSVTMEWLGNHCKKGA

SEQ ID NO: 550 - protein, 114 aa, Phleum pratense
TDPRYSCQREFALKHLPEDPLFQLVSKLYEVVPGILTELGKVKNPWPNVDAHSGVLLNHFGLVEARYSTVLFGVSRSMGIGSQLIWDRALGLPLERPKSVTMEWLENHCKKVAA

SEQ ID NO: 551 - protein, 90 aa, Phleum pratense
VSKLYEVVPGILTELGKVKNPWPNVDAHSGVLLNHFGLVEARYSTVLFGVSRSMGIGSQLIWDRALGLPLERPKSVTMEWLENHCKKVAA

SEQ ID NO: 552 - protein, 90 aa, Phleum pratense; identical to SEQ ID NO: 551

SEQ ID NO: 553 - protein, 114 aa, Phleum pratense
TDPRYSCQREFALKHLPEDPLFQLVSKLYEVVPGILTELGKVKNPWPNVDAHSGVLLNHFGLVEARYCTVLFGVSRSMGIGSQLIWDRALGLPLERPKSVTMEWLENHCKKVAA

SEQ ID NO: 554 - protein, 89 aa, Phleum pratense
EDPLFQLVSKLYEVVPGILTELGKVKNPWPNVDAHSGVLLNHFGLVEARYCTVLFGVSRSMGIGSQLIWDRALGLPLERPKSVTMEWLG

SEQ ID NO: 555 - protein, 215 aa, Phleum pratense
PRPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPTAEEIADRVNKMLAVLDTNILWVNPDCGLKTRKYAEVMPALTNMVTAAKLIRTQLASTK

SEQ ID NO: 556 - protein, 211 aa, Phleum pratense
KGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPTAEEIADRVNKMLAVLDTNILWVNPDCGLKTRKYAEVMPALTNMVTAAKLIRTQLASTK

SEQ ID NO: 557 - protein, 45 aa, Phleum pratense
VFREGVVYGAGIGPGVYDIHSPRIPSKEEIADRVNKMLAVLDTNI

SEQ ID NO: 558 - protein, 211 aa, Phleum pratense; identical to SEQ ID NO: 556

SEQ ID NO: 559 - protein, 212 aa, Phleum pratense
MKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPTAEEIADRVNKMLAVLDTNILWVNPDCGLKTRKYAEVMPALTNMVTAAKLIRTQLASTK

SEQ ID NO: 560 - protein, 215 aa, Phleum pratense; identical to SEQ ID NO: 555

SEQ ID NO: 561 - protein, 201 aa, Phleum pratense
LNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPTAEEIADRVNKMLAVLDTNILWVNPDCGLKTRKYAEVMPALTNMVTAAKLIRTQLASTK

SEQ ID NO: 562 - protein, 161 aa, Phleum pratense
PRPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIHSIINMDADVITIENSRSDEKLLSVFREGVTYGAGIGPGVYDIHSPRIPTAEEI

SEQ ID NO: 563 - protein, 71 aa, Phleum pratense
LSELRNELGGRGIKDEGLVVAPGQGPEGLTVGNIIAGDRFSMAYDRTPEEILAIVYGTGNPAQAGGFFPQG

SEQ ID NO: 564 - protein, 260 aa, Phleum pratense
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNADEGGDEIKEASKPEGEGH

SEQ ID NO: 565 - protein, 260 aa, Phleum pratense; identical to SEQ ID NO: 564

SEQ ID NO: 566 - protein, 158 aa, Phleum pratense
SIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQ

SEQ ID NO: 567 - protein, 160 aa, Phleum pratense
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKS

SEQ ID NO: 568 - protein, 260 aa, Phleum pratense; identical to SEQ ID NO: 564

SEQ ID NO: 569 - protein, 114 aa, Phleum pratense
RKEAAENTLVAYKSAQDIALADLPTTHPIRLGLALNFSVFYYEILNSPDRACNLAKQAFDEAIAELDSLGEESYKDSTLIMQLLRDNLTLWTSDNADEGGDEIKEASKPEGEGH

SEQ ID NO: 570 - protein, 80 aa, Phleum pratense
FSVFYYEILNSPDRACNLAKQAFDEAISELDSLGEESYKDSTLIMQLLRDNLTLWTSDTNEDGGDEIKEAPAPKESGDGQ

SEQ ID NO: 571 - protein, 242 aa, Phleum pratense
YMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNADEGGDEIKEASK

SEQ ID NO: 572 - protein, 143 aa, Phleum pratense
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKA

SEQ ID NO: 573 - protein, 117 aa, Phleum pratense
GAERKEAAENTLVAYKSAQDIALADLPTTHPIRLGLALNFSVFYYEILNSPDRACNLAKQAFDEAIAELDSLGEESYKDSTLIMQLLRDNLTLWTSDNADEGGDEIKEASKPEGEGH

SEQ ID NO: 574 - protein, 117 aa, Phleum pratense; identical to SEQ ID NO: 573

SEQ ID NO: 575 - protein, 144 aa, Phleum pratense
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAG

SEQ ID NO: 576 - protein, 260 aa, Phleum pratense; identical to SEQ ID NO: 564

SEQ ID NO: 577 - protein, 228 aa, Phleum pratense
RPSSVLPPDLRSAEAELQPPRRPPMAVKVYVVYYSMYGHVGKLAEEIKKGASSVEGVEVKVWQVHEILAEEVLGKMGAPPKTDVPIISPQELAEADGILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFHQGKYFAGIAKKLKGSSA

SEQ ID NO: 578 - protein, 164 aa, Phleum pratense
PEILSEEVLGKMGAPPKTDVPIISPQELAEADGILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFHQGKYFAGIAKKLKGSSA

SEQ ID NO: 579 - protein, 164 aa, Phleum pratense; identical to SEQ ID NO: 578

SEQ ID NO: 580 - protein, 131 aa, Phleum pratense
VGKLAEEIKKGASSVEGVEVKVWQVPEILSEEVLGKMGAPPKTDVPIISPQELAEADGILFGFPTRFGMMASQMKAFFDATGGLWREQSLAGKPAGVFFSTGTQGGGQETTPLTAVTQLTHHGMVFVPVGY

SEQ ID NO: 581 - protein, 115 aa, Phleum pratense
GILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFH

SEQ ID NO: 582 - protein, 235 aa, Phleum pratense
QGTATSAGSRALPFLLQLTKQPATRPSSVLPPDLRSAEAELQPPRRPPMAVKVYVVYYSMYGHVGKLAEEIKKGASSVEGVEVKVWQVPEILSEEVLGKMGAPPKTDVPIISPQELAEADGILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFH

SEQ ID NO: 583 - protein, 141 aa, Phleum pratense
MAVKVYVVYYSMYGHVGKLAEEIKKGASSVEGVEVKVWQVPEILSEEVLGKMGAPPKTDVPIISPQELAEADGILFGFPTRFGMMASQMKAFFDATGGLWREQSLAGKPAGVFFSTGTQGGGQETTPLTAVTQLTQHGMVF

SEQ ID NO: 584 - protein, 182 aa, Phleum pratense
IKKGASSVEGVEVKVWQVPEILSEEVLGKMGAPPKTDVPIISPQELAEADGILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFHQGKYFAGIAKKLKGSSA

SEQ ID NO: 585 - protein, 182 aa, Phleum pratense; identical to SEQ ID NO: 584

SEQ ID NO: 586 - protein, 175 aa, Phleum pratense
VEGVEVKVWQVPEILSEEVLGKMGAPPKTDVPIISPQELAEADGILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFHQGKYFAGIAKKLKGSSA

SEQ ID NO: 587 - protein, 148 aa, Phleum pratense
KTDVPIISPQELAEADGILFGFPTRFGMMASQMKAFFDATGGLWREQSLAGKPAGVFFSTGTQGGGQETTPLTAVTQLTHHGMVFVPVGYTFGAKMFDMEKVQGGSPYGAGTFAGDGSRWPSEMELEHAFHQGKYFAGIAKKLKGSSA

SEQ ID NO: 588 - protein, 21 aa, Phleum pratense
ADVYPTVCLPMCVCVLFVTCS

SEQ ID NO: 589 - protein, 662 aa, Phleum pratense
GLGRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAY

SEQ ID NO: 590 - protein, 704 aa, Phleum pratense
GLGRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 591 - protein, 704 aa, Phleum pratense
GLGRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKADRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 592 - protein, 380 aa, Phleum pratense
GNISYHAHYSPHFSPLAFGPEPAYFATAESVRDHLLQRWNDTYLHFHKTDPKQTYYLSMEYLQGRALTNAVGNLGITGAYAEAVKKFGYELEALAGQERDMALGNGGLGRLAACFLDSMATLNLPAWGYGLRYRYGLFKQRIAKEGQEEIAEDWLEKFSPWEIVRHDVVYPVRFFGHVEISPDGSRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKR

SEQ ID NO: 593 - protein, 810 aa, Phleum pratense
GNISYHAHYSPHFSPLAFGPEPAYFATAESVRDHLLQRWNDTYLHFHKTDPKQTYYLSMEYLQGRALTNAVGNLGITGAYAEAVKKFGYELEALAGQERDMALGNGGLGRLAACFLDSMATLNLPAWGYGLRYRYGLFKQRIAKEGQEEIAEDWLEKFSPWEIVRHDVVYPVRFFGHVEISPDGSRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 594 - protein, 701 aa, Phleum pratense
RLAACFLDSMATLNLPAWGYGLRYRYGLFKQRIAKEGQEEIAEDWLEKFSPWEIVRHDVVYPVRFFGHVEISPDGSRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 595 - protein, 615 aa, Phleum pratense
RYRYGLFKQRIAKEGQEEIAEDWLEKFSPWEIVRHDVVYPVRFFGHVEISPDGSRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGE

SEQ ID NO: 596 - protein, 615 aa, Phleum pratense; identical to SEQ ID NO: 595

SEQ ID NO: 597 - protein, 479 aa, Phleum pratense
ISYHAHYSPHFSPLAFGPEPAYFATAESVRDHLLQRWNDTYLHFHKTDPKQTYYLSMEYLQGRALTNAVGNLGITGAYAEAVKKFGYELEALAGQERDMALGNGGLGRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKT

SEQ ID NO: 598 - protein, 727 aa, Phleum pratense
VKKFGYELEALAGQERDMALGNGGLGRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 599 - protein, 705 aa, Phleum pratense
RPRRRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 600 - protein, 705 aa, Phleum pratense
RPRRRLAACFLDSMATLNLPAWGYGLRYRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKADRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 601 - protein, 678 aa, Phleum pratense
FRYGLFKQRIAKEGQEEIAEDWLEKFSPWEIVRHDVVYPVRFFGHVEILPDGRRKSAGGEVLNALAYDVPIPGYKTKNAISLRLWDAKASAEDFNLFQFNDGQYESAAQLHSRAQQICAVLYPGDATEEGKLLRLKQQFFLCSASLQDIIFRFKERKSDRVSGKWSEFPSKVAVQMNDTHPTLAIPELMRLLMDEEGLGWDEAWDVTNKTVAYTNHTVLPEALEKWSQSVMRKLLPRQMEIIEEIDKRFREMVISTRKDMEGKLDSMSVLDNSPQKPVVRMANLCVVSAHTVNGVAELHSNILKEELFADYVSIWPKKFQNKTNGITPRRWLRFCNPELSEIVTKWLKTDQWTSNLDLLTGLRKFADDEKLHAEWAAAKLASKKRLAKHVLDATGVTIDPTSLFDIQIKRIHEYKRQLMNILGAVYRYKKLKEMSAEEKQKVTPRTVMVGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGEDNFFLFGAKADQVAGLRKDRENGLFKPDPRFEEAKQYIRSGTFGTYDYTPLLDSLEGNSGFGRGDYFLVGYDFPSYIDAQARVDEAYKDKKRWIKMSILNTAGSGKFSSDRTIDQYAKEIWGITANPVP

SEQ ID NO: 602 - protein, 253 aa, Phleum pratense
SIHTDTHARHAQSLPRKQKTHEAMALRTLASKKTLAVALGGARPLATRGVATFTLPDLPYDYGALEPAISGEIMRLHHQKHHATYVANYNKALEQLDAAVSKGDASAVVQLQGAIKFNGGGHVNHSIFWKNLKPTNEGGGEAPHGKLGWAIDEDFGSFDKLVKKMNAEGAALQGSGWVWLALDKEAKKLSVETTANQDPLVTKGANLIPLLGIDVWEHAYYLQYKNVRPDYLTNIWKVVNWKYAGEEYENVAA

SEQ ID NO: 603 - protein, 211 aa, Phleum pratense
RKQKTHEAMALRTLASKKTLAVALGGARPLATRGVATFTLPDLPYDYGALEPAISGEIMRLHHQKHHATYVANYNKALEQLDAAVSKGDASAVVQLQGAIKFNGGGHVNHSIFWKNLKPTNEGGGEAPHGKLGWAIDEDFGSFDKLVKKMNAEGAALQGSGWVWLALDKEAKKLSVETTANQDPLVTKGANLIPLLGIDVWEHAYYLQYKN

SEQ ID NO: 604 - protein, 246 aa, Phleum pratense
ARHAQSLPRKQKTHEAMALRTLASKKTLAVALGGARPLATRGVATFTLPDLPYDYGALEPAISGEIMRLHHQKHHATYVANYNKALEQLDAAVSKGDASAVVQLQGAIKFNGGGHVNHSIFWKNLKPTNEGGGEAPHGKLGWAIDEDFGSFDKLVKKMNAEGAALQGSGWVWLALDKEAKKLSVETTANQDPLVTKGANLIPLLGIDVWEHAYYLQYKNVRPDYLTNIWKVVNWKYAGEEYENVAA

SEQ ID NO: 605 - protein, 209 aa, Phleum pratense
LATRGVATFTLPDLPYDYGALEPAISGEIMRLHHQKHHATYVANYNKALEQLDAAVSKGDASAVVQLQGAIKFNGGGHVNHSIFWKNLKPTNEGGGEAPHGKLGWAIDEDFGSFDKLVKKMNAEGAALQGSGWVWLALDKEAKKLSVETTANQDPLVTKGANLIPLLGIDVWEHAYYLQYKNVRPDYLTNIWKVVNWKYAGEEYENVAA

SEQ ID NO: 606 - protein, 79 aa, Phleum pratense
GSGWVWLALDKEAKKLSVETTANQDPLVTKGANLIPLLGIDVWEHAYYLQYKNVRPDYLTNIWKVVNWKYAGEEFFFFF

SEQ ID NO: 607 - protein, 172 aa, Phleum pratense
RHAQSLPRKQKTHEAMALRTLASKKTLAVALGGARPLATRGVATFTLPDLPYDYGALEPAISGEIMRLHHQKHHATYVANYNKALEQLDAAVSKGDASAVVQLQGAIKFNGGGHVNHSIFWKNLKPTNEGGGEAPHGKLGWAIDEDFGSFDKLVKKMNAEGAALQGSGWVWL

SEQ ID NO: 608 - protein, 133 aa, Phleum pratense
HSIFWKNLKPTNEGGGEAPHGKLGWAIDEDFGSFDKLVKKMNAEGAALQGSGWVWLALDKEAKKLSVETTANQDPLVTKGANLIPLLGIDVWEHAYYLQYKNVRPDYLTNIWKVVNWKYAGEEYENVAAEYFV

SEQ ID NO: 609 - protein, 179 aa, Phleum pratense
PGDRPSEMAANPRVFFDVTIGGAPAGRIVMELYADVVPKTAENFRALCTGEKGVGKMGKPLHYKGSSFHRVIPGFMCQGGDFTAGNGTGGESIYGAKFADENFIKKHTGEGVLSMANAGPGTNGSQFFLCTAKTAWLDGKHVVFGQVVEGMDVVKAVEKVGSQSGRCSKPVVIADCGQL

SEQ ID NO: 610 - protein, 191 aa, Phleum pratense
RNPNPQTPASTDPGDRASEMAANPRVFFDVTIGGAPAGRIVMELYADVVPKTAENFRALCTGEKGVGKMGKPLHYKGSSFHRVIPGFMCQGGDFTAGNGTGGESIYGAKFADENFIKKHTGEGVLSMANAGPGTNGSQFFLCTAKTAWLDGKHVVFGQVVEGMDVVKAVEKVGSQSGRCSKPVVIADCGQL

SEQ ID NO: 611 - protein, 172 aa, Phleum pratense
MAPNPKVFFDITIGGAPSGRIVMELYADVVPKTAENFRALCTGEKGVGKMGKPLHYKGSSFHRVIPGFMCQGGDFTAGNGTGGESIYGAKFADENFIKKHTGEGVLSMANAGPGTNGSQFFLCTAKTAWLDGKHVVFGQVVEGMDVVKAIEKVGSQSGRCSKPVVIADCGQL

SEQ ID NO: 612 - protein, 172 aa, Phleum pratense; identical to SEQ ID NO: 611

SEQ ID NO: 613 - protein, 172 aa, Phleum pratense; identical to SEQ ID NO: 611

SEQ ID NO: 614 - protein, 172 aa, Phleum pratense
MAPNPKVFFDITIGGAPSGRIVMELYADVVPKTAENFRALCTGEKGVGKMGKPLHYKGSSFHRVIPGFMCQGGDFTAGNGTGGESIYGAKFADENFIKKHTGEGVLSMANAGPGTNGSQFFLCTAKTAWLDGKHVVFGQVVEGMDVVKAVEKVGSQSGRCSKPVVIADCGQL

SEQ ID NO: 615 - protein, 172 aa, Phleum pratense; identical to SEQ ID NO: 614

SEQ ID NO: 616 - protein, 84 aa, Phleum pratense
AKFADENFVKKHTGPGVLSMANAGPGTNGSQFFLCTAKTAWLDGKHVVFGQVVEGMDVVKAIEKVGSQSGRCSKPVVIADCGQL

SEQ ID NO: 617 - protein, 111 aa, Phleum pratense
PLKWSGFMCQGGDFTKGNGTGGESIYGAKFADENFVKKHTGPGVLSMANAEPGTNGSQFFLCTAKTAWLDGKHVVFGQVVEGMDVVKAVEKVGSQSGRCSKPVVIADCGQL

SEQ ID NO: 618 - protein, 115 aa, Phleum pratense
GSSFHRVIPDFMCQGGDFTKGNGTGGESIYGAKFADENFVKKHTGPGVLSMANAGPGTNGSQFFLCTAKTAWLDGKHVVFGQVVEGMDVVKAVEKVGSQSGRCSKPVVIADCGQL

SEQ ID NO: 619 - protein, 58 aa, Phleum pratense
SQVHIRRPGGAGRDGGQLRIPSLLHGGHGCAQPAMERRKHIEWNCDVCRHGDDKKKVD

SEQ ID NO: 620 - protein, 54 aa, Phleum pratense
WTTVMRASCGHHRFRDCVISSLADFKLFPVLQHIISIAVLAIFIGLLMIEDTGA

SEQ ID NO: 621 - protein, 15 aa, Phleum pratense
SDGTFARAAVPSGAS

SEQ ID NO: 622 - protein, 15 aa, Phleum pratense
RAAVPSGASTGVYEA

SEQ ID NO: 623 - protein, 15 aa, Phleum pratense
GASTGVYEALELRDG

SEQ ID NO: 624 - protein, 15 aa, Phleum pratense
LGKGVLKGNRANVEL

SEQ ID NO: 625 - protein, 15 aa, Phleum pratense
NRANVELFHIAVLLA

SEQ ID NO: 626 - protein, 15 aa, Phleum pratense
QTELDNFMVHQLDGT

SEQ ID NO: 627 - protein, 15 aa, Phleum pratense
CKQKVFFNISADADA

SEQ ID NO: 628 - protein, 15 aa, Phleum pratense
PAMAATIQSVKARQI

SEQ ID NO: 629 - protein, 15 aa, Phleum pratense
VDNVNSIIGPALIGK

SEQ ID NO: 630 - protein, 15 aa, Phleum pratense
KLGANAILAVSLAVC

SEQ ID NO: 631 - protein, 15 aa, Phleum pratense
KKIPLYQHIANLAGN

SEQ ID NO: 632 - protein, 15 aa, Phleum pratense
GNKQLVLPVPAFNVI

SEQ ID NO: 633 - protein, 15 aa, Phleum pratense
KLAMQEFMILPTGAS

SEQ ID NO: 634 - protein, 15 aa, Phleum pratense
KMGVEVYHNLKSVIK

SEQ ID NO: 635 - protein, 15 aa, Phleum pratense
GKVVIGMDVAASEFY

SEQ ID NO: 636 - protein, 15 aa, Phleum pratense
VYKSFVSEYPIVSIE

SEQ ID NO: 637 - protein, 15 aa, Phleum pratense
IVGDDLLVTNPTRVA

SEQ ID NO: 638 - protein, 15 aa, Phleum pratense
NALLLKVNQIGSVTE

SEQ ID NO: 639 - protein, 15 aa, Phleum pratense
ETEDTFIADLAVGLS

SEQ ID NO: 640 - protein, 15 aa, Phleum pratense
ERLAKYNQLLRIEEE

SEQ ID NO: 641 - protein, 15 aa, Phleum pratense
LGAAAVYAGLKFRAP

SEQ ID NO: 642 - protein, 15 aa, Phleum pratense
ADPCSEYFVEAYLNN

SEQ ID NO: 643 - protein, 15 aa, Phleum pratense
YFVEAYLNNPLVQKA

SEQ ID NO: 644 - protein, 15 aa, Phleum pratense
VQKAIHANTALNYPW

SEQ ID NO: 645 - protein, 15 aa, Phleum pratense
PSMLAHIKALVTTGI

SEQ ID NO: 646 - protein, 15 aa, Phleum pratense
LYSGDLDAMVPVTAS

SEQ ID NO: 647 - protein, 15 aa, Phleum pratense
LNYPWTGCRTRTYNL

SEQ ID NO: 648 - protein, 15 aa, Phleum pratense
YNLRRFGASPPSMLA

SEQ ID NO: 649 - protein, 15 aa, Phleum pratense
HIKALVTTASASGCT

SEQ ID NO: 650 - protein, 15 aa, Phleum pratense
QEMAYWSLKAAIEIG

SEQ ID NO: 651 - protein, 15 aa, Phleum pratense
DAASSLYLFGENLPR

SEQ ID NO: 652 - protein, 15 aa, Phleum pratense
GYNISLASMIPDYDT

SEQ ID NO: 653 - protein, 15 aa, Phleum pratense
YDTVITNVRRSLAVA

SEQ ID NO: 654 - protein, 15 aa, Phleum pratense
LEKIVAILSAFVDAA

SEQ ID NO: 655 - protein, 15 aa, Phleum pratense
NVRRSLAVAKKNHLA

SEQ ID NO: 656 - protein, 15 aa, Phleum pratense
VAKKNHLAWNCERCR

SEQ ID NO: 657 - protein, 15 aa, Phleum pratense
LAWNCERCRKGESKK

SEQ ID NO: 658 - protein, 15 aa, Phleum pratense
KKTVDAILSAFVDAA

SEQ ID NO: 659 - protein, 15 aa, Phleum pratense
GSGDFKTIKEALAKV

SEQ ID NO: 660 - protein, 15 aa, Phleum pratense
MYVMYIKEGTYKEYV

SEQ ID NO: 661 - protein, 15 aa, Phleum pratense
YKEYVTVPRTVTNLV

SEQ ID NO: 662 - protein, 15 aa, Phleum pratense
VTNLVMIGDGAAKTI

SEQ ID NO: 663 - protein, 15 aa, Phleum pratense
NFKMNLTSMVAVSLV

SEQ ID NO: 664 - protein, 15 aa, Phleum pratense
YQDTLYTHAQRQFFR

SEQ ID NO: 665 - protein, 15 aa, Phleum pratense
GTIDFIFGNSQVVIQ

SEQ ID NO: 666 - protein, 15 aa, Phleum pratense
AKTIILKFLLPVMIV

SEQ ID NO: 667 - protein, 15 aa, Phleum pratense
ALTHTTIVASGIENM

SEQ ID NO: 668 - protein, 15 aa, Phleum pratense
MKIFTRTWVLLLLVV

SEQ ID NO: 669 - protein, 15 aa, Phleum pratense
LLLLVVLLFEGCLAK

SEQ ID NO: 670 - protein, 15 aa, Phleum pratense
KDTHYTLSAWLQLSK

SEQ ID NO: 671 - protein, 15 aa, Phleum pratense
GKGELFFETNVTAEL

SEQ ID NO: 672 - protein, 15 aa, Phleum pratense
VTAELMVDSMSLQPF

SEQ ID NO: 673 - protein, 15 aa, Phleum pratense
YEKWFTSRFTVATME

SEQ ID NO: 674 - protein, 15 aa, Phleum pratense
KQMDWVSKLSAPQLK

SEQ ID NO: 675 - protein, 15 aa, Phleum pratense
KPILFMNEYNTIEEP

SEQ ID NO: 676 - protein, 15 aa, Phleum pratense
TKYLAKLKQIQSYPG

SEQ ID NO: 677 - protein, 15 aa, Phleum pratense
PYVRGSLDTLAQAKV

SEQ ID NO: 678 - protein, 15 aa, Phleum pratense
PKQVEYLEEVMREGF

SEQ ID NO: 679 - protein, 15 aa, Phleum pratense
NVTAELVDSMSLQPF

SEQ ID NO: 680 - protein, 15 aa, Phleum pratense
NIPATWGAMEKLYDA

SEQ ID NO: 681 - protein, 15 aa, Phleum pratense
GAMEKLYDAGKARAI

SEQ ID NO: 682 - protein, 15 aa, Phleum pratense
KARAIGVSNLASKKL

SEQ ID NO: 683 - protein, 15 aa, Phleum pratense
VSNLASKKLGDLLAV

SEQ ID NO: 684 - protein, 15 aa, Phleum pratense
KKLGDLLAVARIPPA

SEQ ID NO: 685 - protein, 15 aa, Phleum pratense
SVFKKFPKFRRVLVI

SEQ ID NO: 686 - protein, 15 aa, Phleum pratense
PKFRRVLVIDPVISG

SEQ ID NO: 687 - protein, 15 aa, Phleum pratense
IGEIKGFADAVMVSR

SEQ ID NO: 688 - protein, 15 aa, Phleum pratense
FADAVMVSRGSLVRV

SEQ ID NO: 689 - protein, 15 aa, Phleum pratense
VSRGSLVRVNGFFLT

SEQ ID NO: 690 - protein, 15 aa, Phleum pratense
VNGFFLTGFNDLVTE

SEQ ID NO: 691 - protein, 15 aa, Phleum pratense
QIIRKGFYLTKNVEH

SEQ ID NO: 692 - protein, 15 aa, Phleum pratense
FYLTKNVEHKGQVDL

SEQ ID NO: 693 - protein, 15 aa, Phleum pratense
VEHKGQVDLVTETDK

SEQ ID NO: 694 - protein, 15 aa, Phleum pratense
TDKACEDLIFNHLRK

SEQ ID NO: 695 - protein, 15 aa, Phleum pratense
DLIFNHLRKLYPDHK

SEQ ID NO: 696 - protein, 15 aa, Phleum pratense
AEFEGVFLDFARQQA

SEQ ID NO: 697 - protein, 15 aa, Phleum pratense
VDKLFKLAEAAKLKE

SEQ ID NO: 698 - protein, 15 aa, Phleum pratense
ENRSVLHVALRAPRD

SEQ ID NO: 699 - protein, 15 aa, Phleum pratense
FLGPLFVHTALQTDP

SEQ ID NO: 700 - protein, 15 aa, Phleum pratense
RQLRFLANVDPVDVA

SEQ ID NO: 701 - protein, 15 aa, Phleum pratense
VVSKTFTTAETMLNA

SEQ ID NO: 702 - protein, 15 aa, Phleum pratense
IKEWIVSSLGPQAVS

SEQ ID NO: 703 - protein, 15 aa, Phleum pratense
VSKHMIAVSTNLKLV

SEQ ID NO: 704 - protein, 15 aa, Phleum pratense
RYSVCSAVGVLPLSL

SEQ ID NO: 705 - protein, 15 aa, Phleum pratense
AVGVLPLSLQYGFPI

SEQ ID NO: 706 - protein, 15 aa, Phleum pratense
LSLQYGFPIVQRFLE

SEQ ID NO: 707 - protein, 15 aa, Phleum pratense
FPIVQRFLEGASSID

SEQ ID NO: 708 - protein, 15 aa, Phleum pratense
HFRTASFEKNIPVLL

SEQ ID NO: 709 - protein, 15 aa, Phleum pratense
VLLGLLSVWNVSFLG

SEQ ID NO: 710 - protein, 15 aa, Phleum pratense
SVWNVSFLGYPARAI

SEQ ID NO: 711 - protein, 15 aa, Phleum pratense
ARAILPYSQALEKLA

SEQ ID NO: 712 - protein, 15 aa, Phleum pratense
NGQHSFYQLIHQGRV

SEQ ID NO: 713 - protein, 15 aa, Phleum pratense
CDFIGVIKSQQPVYL

SEQ ID NO: 714 - protein, 15 aa, Phleum pratense
ELMSNFFAQPDALAY

SEQ ID NO: 715 - protein, 15 aa, Phleum pratense
KTFKGNRPSLSFLLS

SEQ ID NO: 716 - protein, 15 aa, Phleum pratense
PSLSFLLSSLSAYEI

SEQ ID NO: 717 - protein, 15 aa, Phleum pratense
AYEIGQLLAIYEHRI

SEQ ID NO: 718 - protein, 15 aa, Phleum pratense
LLAIYEHRIAVQGFI

SEQ ID NO: 719 - protein, 15 aa, Phleum pratense
QGFIWGINSFDQWGV

SEQ ID NO: 720 - protein, 15 aa, Phleum pratense
PVEGFNPSSASLLAR

SEQ ID NO: 721 - protein, 15 aa, Phleum pratense
PSSASLLARYLAVEP

SEQ ID NO: 722 - protein, 15 aa, Phleum pratense
KELGGKILRQPGPLP

SEQ ID NO: 723 - protein, 15 aa, Phleum pratense
ILRQPGPLPGLNTKI

SEQ ID NO: 724 - protein, 15 aa, Phleum pratense
LRGLNTKIASFLDPD

SEQ ID NO: 725 - protein, 15 aa, Phleum pratense
KIASFLDPDGWKVVL

SEQ ID NO: 726 - protein, 15 aa, Phleum pratense
GWKVVLVDHADFLKE

SEQ ID NO: 727 - protein, 15 aa, Phleum pratense
QDNAKIVQIDSSIQA

SEQ ID NO: 728 - protein, 15 aa, Phleum pratense
RLVCLRVHPTFTLLH

SEQ ID NO: 729 - protein, 15 aa, Phleum pratense
HPTFTLLHPTEVVVA

SEQ ID NO: 730 - protein, 15 aa, Phleum pratense
TEVVVAFTAINGSRQ

SEQ ID NO: 731 - protein, 15 aa, Phleum pratense
LVNRFEISQVSKCLV

SEQ ID NO: 732 - protein, 15 aa, Phleum pratense
ILLVFAETAEPEVKV

SEQ ID NO: 733 - protein, 15 aa, Phleum pratense
EPEVKVVDLTILSPD

SEQ ID NO: 734 - protein, 15 aa, Phleum pratense
LKDGSTYSFRFSFIV

SEQ ID NO: 735 - protein, 15 aa, Phleum pratense
SFRFSFIVSNNIVSG

SEQ ID NO: 736 - protein, 15 aa, Phleum pratense
DDGKVYLEMSYYFEI

SEQ ID NO: 737 - protein, 15 aa, Phleum pratense
VKKIVTVLNEAEVPS

SEQ ID NO: 738 - protein, 15 aa, Phleum pratense
EDAVEVVVSPPFVFL

SEQ ID NO: 739 - protein, 15 aa, Phleum pratense
VSPPFVFLQQAKALL

SEQ ID NO: 740 - protein, 15 aa, Phleum pratense
FLQQAKALLRPDFAV

SEQ ID NO: 741 - protein, 15 aa, Phleum pratense
ALLRPDFAVAAQNCW

SEQ ID NO: 742 - protein, 15 aa, Phleum pratense
GAFTGEISAEMLVNL

SEQ ID NO: 743 - protein, 15 aa, Phleum pratense
ISAEMLVNLQVPWVI

SEQ ID NO: 744 - protein, 15 aa, Phleum pratense
ESNDFVADKVAYALA

SEQ ID NO: 745 - protein, 15 aa, Phleum pratense
ADKVAYALAQGLKVI

SEQ ID NO: 746 - protein, 15 aa, Phleum pratense
TTMEVVAAQTKAIAE

SEQ ID NO: 747 - protein, 15 aa, Phleum pratense
WTNVVLAYEPVWAIG

SEQ ID NO: 748 - protein, 15 aa, Phleum pratense
LRKWLHANVGPAVAE

SEQ ID NO: 749 - protein, 15 aa, Phleum pratense
PEFVDIIKSATVKSS

SEQ ID NO: 750 - protein, 15 aa, Phleum pratense
LNGPFIATVQQRGAA

SEQ ID NO: 751 - protein, 15 aa, Phleum pratense
QQRGAAIIKARKLSS

SEQ ID NO: 752 - protein, 15 aa, Phleum pratense
IIKARKLSSALSAAS

SEQ ID NO: 753 - protein, 15 aa, Phleum pratense
LSSALSAASSACDHI

SEQ ID NO: 754 - protein, 15 aa, Phleum pratense
GTPEGTFVSMGVYSD

SEQ ID NO: 755 - protein, 15 aa, Phleum pratense
IEIDSLFEGIDFYST

SEQ ID NO: 756 - protein, 15 aa, Phleum pratense
IDFYSTITRARFEEL

SEQ ID NO: 757 - protein, 15 aa, Phleum pratense
IPKVQQLLQDFFNGK

SEQ ID NO: 758 - protein, 15 aa, Phleum pratense
EAVAYGAAVQAAILS

SEQ ID NO: 759 - protein, 15 aa, Phleum pratense
VQDLLLLDVTPLSLG

SEQ ID NO: 760 - protein, 15 aa, Phleum pratense
LMSFSWICACVRAAA

SEQ ID NO: 761 - protein, 15 aa, Phleum pratense
ICACVRAAAVAWEAG

SEQ ID NO: 762 - protein, 15 aa, Phleum pratense
VRVKILFTALCHTDV

SEQ ID NO: 763 - protein, 15 aa, Phleum pratense
MCDLLRINTDRGVMI

SEQ ID NO: 764 - protein, 15 aa, Phleum pratense
KPIFHFVGTSTFSEY

SEQ ID NO: 765 - protein, 15 aa, Phleum pratense
VGTSTFSEYTVMHVG

SEQ ID NO: 766 - protein, 15 aa, Phleum pratense
VAIFGLGAVGLAAAE

SEQ ID NO: 767 - protein, 15 aa, Phleum pratense
GAVGLAAAEGARIAG

SEQ ID NO: 768 - protein, 15 aa, Phleum pratense
GNINAMIQAFECVHD

SEQ ID NO: 769 - protein, 15 aa, Phleum pratense
LKGTFFGNFKPRTDL

SEQ ID NO: 770 - protein, 15 aa, Phleum pratense
KFITHSVTFSEINKA

SEQ ID NO: 771 - protein, 15 aa, Phleum pratense
VTFSEINKAFDLMAK

SEQ ID NO: 772 - protein, 15 aa, Phleum pratense
ALRWNLQMGHSVLPK

SEQ ID NO: 773 - protein, 15 aa, Phleum pratense
NLDVYDWSIPDDLLA

SEQ ID NO: 774 - protein, 15 aa, Phleum pratense
DDLLAKFSEIKQTRL

SEQ ID NO: 775 - protein, 15 aa, Phleum pratense
FSEIKQTRLLMGNFI

SEQ ID NO: 776 - protein, 15 aa, Phleum pratense
TRLLMGNFIVNKDSV

SEQ ID NO: 777 - protein, 15 aa, Phleum pratense
MKTIFDFESIKKLLA

SEQ ID NO: 778 - protein, 15 aa, Phleum pratense
FESIKKLLASPKFSF

SEQ ID NO: 779 - protein, 15 aa, Phleum pratense
RMFVDELGASESSLL

SEQ ID NO: 780 - protein, 15 aa, Phleum pratense
PNLTYAKELVERMGL

SEQ ID NO: 781 - protein, 15 aa, Phleum pratense
RNMVLGKRFFVTPSD

SEQ ID NO: 782 - protein, 15 aa, Phleum pratense
KRFFVTPSDSVAIIA

SEQ ID NO: 783 - protein, 15 aa, Phleum pratense
SDSVAIIAANAVQSI

SEQ ID NO: 784 - protein, 15 aa, Phleum pratense
AVQSIPYFASGLKGV

SEQ ID NO: 785 - protein, 15 aa, Phleum pratense
KNLNLKFFEVPTGWK

SEQ ID NO: 786 - protein, 15 aa, Phleum pratense
GIWAVLAWLSIIAYK

SEQ ID NO: 787 - protein, 15 aa, Phleum pratense
NLGGDKLVSVEDIVL

SEQ ID NO: 788 - protein, 15 aa, Phleum pratense
LVSVEDIVLQHWATY

SEQ ID NO: 789 - protein, 15 aa, Phleum pratense
KELMANLVKMQSALS

SEQ ID NO: 790 - protein, 15 aa, Phleum pratense
LVKMQSALSDVNKLI

SEQ ID NO: 791 - protein, 15 aa, Phleum pratense
HQGIRYLFGDGSRLV

SEQ ID NO: 792 - protein, 15 aa, Phleum pratense
SRLVFRLSGTGSVGA

SEQ ID NO: 793 - protein, 15 aa, Phleum pratense
GATIRIYIEQYEKDS

SEQ ID NO: 794 - protein, 15 aa, Phleum pratense
DALSPLVDVALKLSK

SEQ ID NO: 795 - protein, 15 aa, Phleum pratense
QDFKKVNEIYAKYFP

SEQ ID NO: 796 - protein, 15 aa, Phleum pratense
NEIYAKYFPSPAPAR

SEQ ID NO: 797 - protein, 15 aa, Phleum pratense
YFPSPAPARSTYQVA

SEQ ID NO: 798 - protein, 15 aa, Phleum pratense
ARSTYQVAALPLDAR

SEQ ID NO: 799 - protein, 15 aa, Phleum pratense
LPLDARIEIECIAAL

SEQ ID NO: 800 - protein, 15 aa, Phleum pratense
PPPGQHIAMAASSRR

SEQ ID NO: 801 - protein, 15 aa, Phleum pratense
ASQLLGSAASRFLHS

SEQ ID NO: 802 - protein, 15 aa, Phleum pratense
SRFLHSRGYAAAAAA

SEQ ID NO: 803 - protein, 15 aa, Phleum pratense
RGYAAAAAAPSPAVF

SEQ ID NO: 804 - protein, 15 aa, Phleum pratense
LGLPVFNSVAEAKAE

SEQ ID NO: 805 - protein, 15 aa, Phleum pratense
TKANASVIYVPPPFA

SEQ ID NO: 806 - protein, 15 aa, Phleum pratense
VIYVPPPFAAAAIME

SEQ ID NO: 807 - protein, 15 aa, Phleum pratense
PFAAAAIMEALEAEL

SEQ ID NO: 808 - protein, 15 aa, Phleum pratense
QHDMVKVKAALNRQS

SEQ ID NO: 809 - protein, 15 aa, Phleum pratense
TLTYEAVFQTTAVGL

SEQ ID NO: 810 - protein, 15 aa, Phleum pratense
DKPVVAFIAGLTAPP

SEQ ID NO: 811 - protein, 15 aa, Phleum pratense
KIKALREAGVTVVES

SEQ ID NO: 812 - protein, 15 aa, Phleum pratense
GSTMFEIFKQRGMVE

SEQ ID NO: 813 - protein, 15 aa, Phleum pratense
TVSDEYLAAVAKARR

SEQ ID NO: 814 - protein, 15 aa, Phleum pratense
LDIAVRLLEPIKEQV

SEQ ID NO: 815 - protein, 15 aa, Phleum pratense
IKEQVPILSYADFYQ

SEQ ID NO: 816 - protein, 15 aa, Phleum pratense
ILSYADFYQLAGVVA

SEQ ID NO: 817 - protein, 15 aa, Phleum pratense
FYQLAGVVAVEITGG

SEQ ID NO: 818 - protein, 15 aa, Phleum pratense
DHLRQVFTAQMGLSD

SEQ ID NO: 819 - protein, 15 aa, Phleum pratense
NPLIFDNSYFTELLT

SEQ ID NO: 820 - protein, 15 aa, Phleum pratense
EDAFFADYAEAHLKL

SEQ ID NO: 821 - protein, 15 aa, Phleum pratense
EDSHFVVELTYNYGV

SEQ ID NO: 822 - protein, 15 aa, Phleum pratense
RAIKFYEKAFGMELL

SEQ ID NO: 823 - protein, 15 aa, Phleum pratense
NPQYKYTIAMMGYGP

SEQ ID NO: 824 - protein, 15 aa, Phleum pratense
KNAVLELTYNYGVKE

SEQ ID NO: 825 - protein, 15 aa, Phleum pratense
DGWKSVFVDNLDFLK

SEQ ID NO: 826 - protein, 15 aa, Phleum pratense
EEAASTLPGLSSSTL

SEQ ID NO: 827 - protein, 15 aa, Phleum pratense
TLLFPHTQISLPSVR

SEQ ID NO: 828 - protein, 15 aa, Phleum pratense
VRTRKHLAATMADEK

SEQ ID NO: 829 - protein, 15 aa, Phleum pratense
DNEKSGFISLVSRYL

SEQ ID NO: 830 - protein, 15 aa, Phleum pratense
FISLVSRYLSGEEEH

SEQ ID NO: 831 - protein, 15 aa, Phleum pratense
EATKALLNKLAVLKL

SEQ ID NO: 832 - protein, 15 aa, Phleum pratense
IEVRNGFTFLDLIVL

SEQ ID NO: 833 - protein, 15 aa, Phleum pratense
FLDLIVLQIESLNKK

SEQ ID NO: 834 - protein, 15 aa, Phleum pratense
LNKKYGSNVPLLLMN

SEQ ID NO: 835 - protein, 15 aa, Phleum pratense
NVPLLLMNSFNTHED

SEQ ID NO: 836 - protein, 15 aa, Phleum pratense
LKIVEKYANSSIDIH

SEQ ID NO: 837 - protein, 15 aa, Phleum pratense
SIDIHTFNQSQYPRV

SEQ ID NO: 838 - protein, 15 aa, Phleum pratense
GKLDLLLSQGKEYVF

SEQ ID NO: 839 - protein, 15 aa, Phleum pratense
GKEYVFIANSDNLGA

SEQ ID NO: 840 - protein, 15 aa, Phleum pratense
SDNLGAIVDMKILNH

SEQ ID NO: 841 - protein, 15 aa, Phleum pratense
IVDMKILNHLIHKQN

SEQ ID NO: 842 - protein, 15 aa, Phleum pratense
ISYEGRVQLLEIAQV

SEQ ID NO: 843 - protein, 15 aa, Phleum pratense
VQLLEIAQVPDAHVD

SEQ ID NO: 844 - protein, 15 aa, Phleum pratense
FKSIEKFKIFNTNNL

SEQ ID NO: 845 - protein, 15 aa, Phleum pratense
FKIFNTNNLWVNLKA

SEQ ID NO: 846 - protein, 15 aa, Phleum pratense
NNLWVNLKAIKRLVE

SEQ ID NO: 847 - protein, 15 aa, Phleum pratense
IKRLVEADALKMEII

SEQ ID NO: 848 - protein, 15 aa, Phleum pratense
VKVLQLETAAGAAIR

SEQ ID NO: 849 - protein, 15 aa, Phleum pratense
AAIRFFDHAIGINVP

SEQ ID NO: 850 - protein, 15 aa, Phleum pratense
GINVPRSRFLPVKAT

SEQ ID NO: 851 - protein, 15 aa, Phleum pratense
RFLPVKATSDLQLVQ

SEQ ID NO: 852 - protein, 15 aa, Phleum pratense
TSDLQLVQSDLYTLV

SEQ ID NO: 853 - protein, 15 aa, Phleum pratense
VQSDLYTLVDGFVTR

SEQ ID NO: 854 - protein, 15 aa, Phleum pratense
GPEFKKVGSFLGRFK

SEQ ID NO: 855 - protein, 15 aa, Phleum pratense
GRFKSIPSIVELDSL

SEQ ID NO: 856 - protein, 15 aa, Phleum pratense
LQSKNCILYLCSIMI

SEQ ID NO: 857 - protein, 15 aa, Phleum pratense
ILYLCSIMICNCKVS

SEQ ID NO: 858 - protein, 15 aa, Phleum pratense
IMICNCKVSKVLNTY

SEQ ID NO: 859 - protein, 15 aa, Phleum pratense
KVSKVLNTYIFLLYL

SEQ ID NO: 860 - protein, 15 aa, Phleum pratense
GTIRNIINGTVFREP

SEQ ID NO: 861 - protein, 15 aa, Phleum pratense
VFNFTGAGGVALAMY

SEQ ID NO: 862 - protein, 15 aa, Phleum pratense
IQGFAEASMAIAYEK

SEQ ID NO: 863 - protein, 15 aa, Phleum pratense
ASMAIAYEKKWPLYL

SEQ ID NO: 864 - protein, 15 aa, Phleum pratense
EKKWPLYLSTKNTIL

SEQ ID NO: 865 - protein, 15 aa, Phleum pratense
GRFKDIFQAVYEADW

SEQ ID NO: 866 - protein, 15 aa, Phleum pratense
WYEHRLIDDMVAYAL

SEQ ID NO: 867 - protein, 15 aa, Phleum pratense
VQSDFLAQGFGSLGL

SEQ ID NO: 868 - protein, 15 aa, Phleum pratense
NSIASIFAWTRGLAH

SEQ ID NO: 869 - protein, 15 aa, Phleum pratense
DNARLLDFTQKLEDA

SEQ ID NO: 870 - protein, 15 aa, Phleum pratense
MTKDLALLVHGSSKV

SEQ ID NO: 871 - protein, 15 aa, Phleum pratense
LNTEEFIDAVAAELQ

SEQ ID NO: 872 - protein, 15 aa, Phleum pratense
NTRVLLLRRTSPFSA

SEQ ID NO: 873 - protein, 15 aa, Phleum pratense
DGYYIHGQCAIIMFD

SEQ ID NO: 874 - protein, 15 aa, Phleum pratense
QCAIIMFDVTSRLTY

SEQ ID NO: 875 - protein, 15 aa, Phleum pratense
RKKNLQYYEISAKSN

SEQ ID NO: 876 - protein, 15 aa, Phleum pratense
SAKSNYNFEKPFLYL

SEQ ID NO: 877 - protein, 15 aa, Phleum pratense
KPFLYLARKLAGDAN

SEQ ID NO: 878 - protein, 15 aa, Phleum pratense
ANIHFVEAVALKPPE

SEQ ID NO: 879 - protein, 15 aa, Phleum pratense
EAELAAAAAQPLPDD

SEQ ID NO: 880 - protein, 15 aa, Phleum pratense
YQPAAMRRLSLILLA

SEQ ID NO: 881 - protein, 15 aa, Phleum pratense
RRLSLILLAAAALLA

SEQ ID NO: 882 - protein, 15 aa, Phleum pratense
LLAAAALLAAAVSAE

SEQ ID NO: 883 - protein, 15 aa, Phleum pratense
CPRAERIIAEVVQSK

SEQ ID NO: 884 - protein, 15 aa, Phleum pratense
AFDAVVRSKLALELE

SEQ ID NO: 885 - protein, 15 aa, Phleum pratense
CADILAIASRVLVTM

SEQ ID NO: 886 - protein, 15 aa, Phleum pratense
NFTVGRIIELFTAKG

SEQ ID NO: 887 - protein, 15 aa, Phleum pratense
IIELFTAKGFTVQEM

SEQ ID NO: 888 - protein, 15 aa, Phleum pratense
FTVQEMVALSGAHTL

SEQ ID NO: 889 - protein, 15 aa, Phleum pratense
IAAFNDIMSSSVLSS

SEQ ID NO: 890 - protein, 15 aa, Phleum pratense
FDNIYSVNIERGLGL

SEQ ID NO: 891 - protein, 15 aa, Phleum pratense
NTDFFEDFAKAIEKL

SEQ ID NO: 892 - protein, 15 aa, Phleum pratense
TDTIVYCAGRTFFFR

SEQ ID NO: 893 - protein, 15 aa, Phleum pratense
GRTFFFRRLDAPLDA

SEQ ID NO: 894 - protein, 15 aa, Phleum pratense
KSLVRAFMWDSGSTV

SEQ ID NO: 895 - protein, 15 aa, Phleum pratense
RVLSCDFKPTRPFRI

SEQ ID NO: 896 - protein, 15 aa, Phleum pratense
HTGSIYAVSWSADSK

SEQ ID NO: 897 - protein, 15 aa, Phleum pratense
AGHLKTVSSLTYFPQ

SEQ ID NO: 898 - protein, 15 aa, Phleum pratense
VSSLTYFPQSNPRTM

SEQ ID NO: 899 - protein, 15 aa, Phleum pratense
SYDGVIIRWIQGVGY

SEQ ID NO: 900 - protein, 15 aa, Phleum pratense
TQIKCFVAAEEELIT

SEQ ID NO: 901 - protein, 15 aa, Phleum pratense
NALNIAVQQPEFALI

SEQ ID NO: 902 - protein, 15 aa, Phleum pratense
PEFALITTDSAIVLL

SEQ ID NO: 903 - protein, 15 aa, Phleum pratense
TDSAIVLLHKSTVTS

SEQ ID NO: 904 - protein, 15 aa, Phleum pratense
TKVSYTITSSAVSPD

SEQ ID NO: 905 - protein, 15 aa, Phleum pratense
KLRIYSISGDTLTEE

SEQ ID NO: 906 - protein, 15 aa, Phleum pratense
IHYSPDVSMFASADA

SEQ ID NO: 907 - protein, 15 aa, Phleum pratense
IKLKNMLFHTARINC

SEQ ID NO: 908 - protein, 15 aa, Phleum pratense
STKIFLESSTMESRA

SEQ ID NO: 909 - protein, 15 aa, Phleum pratense
CAAVLAASAVVVLVV

SEQ ID NO: 910 - protein, 15 aa, Phleum pratense
VVVLVVASGLAGSRV

SEQ ID NO: 911 - protein, 15 aa, Phleum pratense
LAGSRVVRVAVDVAT

SEQ ID NO: 912 - protein, 15 aa, Phleum pratense
GWYHLFYQYNPEGAV

SEQ ID NO: 913 - protein, 15 aa, Phleum pratense
SRDLIHWRHLPLAMV

SEQ ID NO: 914 - protein, 15 aa, Phleum pratense
LNMLYTGSTNASVQV

SEQ ID NO: 915 - protein, 15 aa, Phleum pratense
IAMVYKTKDFVSYEL

SEQ ID NO: 916 - protein, 15 aa, Phleum pratense
TKDFVSYELIPGLLH

SEQ ID NO: 917 - protein, 15 aa, Phleum pratense
WGKFYASKTFYDPAK

SEQ ID NO: 918 - protein, 15 aa, Phleum pratense
KGWASLMSIPRTVDL

SEQ ID NO: 919 - protein, 15 aa, Phleum pratense
LRHATQLDIEAAFRL

SEQ ID NO: 920 - protein, 15 aa, Phleum pratense
EAAFRLDHAAVAALN

SEQ ID NO: 921 - protein, 15 aa, Phleum pratense
EQTAVYFYVSRGLDG

SEQ ID NO: 922 - protein, 15 aa, Phleum pratense
VKRVVGYTVPVLDGE

SEQ ID NO: 923 - protein, 15 aa, Phleum pratense
EAFSVRVLVDHSIVE

SEQ ID NO: 924 - protein, 15 aa, Phleum pratense
EAIYAAAGVYLFNNA

SEQ ID NO: 925 - protein, 15 aa, Phleum pratense
VYLFNNATSGTVTVE

SEQ ID NO: 926 - protein, 15 aa, Phleum pratense
TDIVEVVVSPPYVFL

SEQ ID NO: 927 - protein, 15 aa, Phleum pratense
SPPYVFLPTVKDKLR

SEQ ID NO: 928 - protein, 15 aa, Phleum pratense
GAFTGEVSAEMLANL

SEQ ID NO: 929 - protein, 15 aa, Phleum pratense
VSAEMLANLGIPWVI

SEQ ID NO: 930 - protein, 15 aa, Phleum pratense
GESSEFVGDKVAYAL

SEQ ID NO: 931 - protein, 15 aa, Phleum pratense
GDKVAYALAQGLKVI

SEQ ID NO: 932 - protein, 15 aa, Phleum pratense
STMTVVAEQTKAIAD

SEQ ID NO: 933 - protein, 15 aa, Phleum pratense
DWTNVVIAYEPVWAI

SEQ ID NO: 934 - protein, 15 aa, Phleum pratense
IAYEPVWAIGTGKVA

SEQ ID NO: 935 - protein, 15 aa, Phleum pratense
LKPEFIDIINAATVK

SEQ ID NO: 936 - protein, 15 aa, Phleum pratense
RTSSWGSGASLKIDR

SEQ ID NO: 937 - protein, 15 aa, Phleum pratense
SLKIDRRELVTTRIY

SEQ ID NO: 938 - protein, 15 aa, Phleum pratense
RFLHAAVAMATKRSV

SEQ ID NO: 939 - protein, 15 aa, Phleum pratense
KGKKVFLRADLNVPL

SEQ ID NO: 940 - protein, 15 aa, Phleum pratense
TRIRASIPTIKFLLE

SEQ ID NO: 941 - protein, 15 aa, Phleum pratense
TIKFLLEKGAKVILA

SEQ ID NO: 942 - protein, 15 aa, Phleum pratense
EKGAKVILASHLGRP

SEQ ID NO: 943 - protein, 15 aa, Phleum pratense
VPRLSELLGVEVVMA

SEQ ID NO: 944 - protein, 15 aa, Phleum pratense
GGVLLLENVRFYKEE

SEQ ID NO: 945 - protein, 15 aa, Phleum pratense
PEFAKKLASVADLYV

SEQ ID NO: 946 - protein, 15 aa, Phleum pratense
KFLRPSVAGFLMQKE

SEQ ID NO: 947 - protein, 15 aa, Phleum pratense
VAGFLMQKELDYLVG

SEQ ID NO: 948 - protein, 15 aa, Phleum pratense
KELDYLVGAVANPKK

SEQ ID NO: 949 - protein, 15 aa, Phleum pratense
KIGVIESLLAKVDIL

SEQ ID NO: 950 - protein, 15 aa, Phleum pratense
GMIFTFYKAQGKAVG

SEQ ID NO: 951 - protein, 15 aa, Phleum pratense
EEDKLELATSLIETA

SEQ ID NO: 952 - protein, 15 aa, Phleum pratense
GVSLLLPTDVVVADK

SEQ ID NO: 953 - protein, 15 aa, Phleum pratense
SAPALRILRSFPSHS

SEQ ID NO: 954 - protein, 15 aa, Phleum pratense
VELVAVNDPFITTDY

SEQ ID NO: 955 - protein, 15 aa, Phleum pratense
DYMTYMFKYDTVHGQ

SEQ ID NO: 956 - protein, 15 aa, Phleum pratense
GGAKKVIISAPSKDA

SEQ ID NO: 957 - protein, 15 aa, Phleum pratense
YTSDITIVSNASCTT

SEQ ID NO: 958 - protein, 15 aa, Phleum pratense
KVINDRFGIVEGLMT

SEQ ID NO: 959 - protein, 15 aa, Phleum pratense
FGIVEGLMTTVHAMT

SEQ ID NO: 960 - protein, 15 aa, Phleum pratense
GGRAASFNIIPSSTG

SEQ ID NO: 961 - protein, 15 aa, Phleum pratense
LTVRLEKAATYEQIK

SEQ ID NO: 962 - protein, 15 aa, Phleum pratense
ALNDNFVKLVSWYDN

SEQ ID NO: 963 - protein, 15 aa, Phleum pratense
VWQHDRVEIIANDQG

SEQ ID NO: 964 - protein, 15 aa, Phleum pratense
VEIIANDQGNRTTPS

SEQ ID NO: 965 - protein, 15 aa, Phleum pratense
TTPSYVAFTDSERLI

SEQ ID NO: 966 - protein, 15 aa, Phleum pratense
KNQVAMNPINTVFGE

SEQ ID NO: 967 - protein, 15 aa, Phleum pratense
NPINTVFGEHLSTCT

SEQ ID NO: 968 - protein, 15 aa, Phleum pratense
SSTRGWCSRRRAGRG

SEQ ID NO: 969 - protein, 15 aa, Phleum pratense
EEKQFAAEEISSMVL

SEQ ID NO: 970 - protein, 15 aa, Phleum pratense
SSMVLIKMREIAEAF

SEQ ID NO: 971 - protein, 15 aa, Phleum pratense
SIKNAVVTVPAYFND

SEQ ID NO: 972 - protein, 15 aa, Phleum pratense
GVIAGLNVLRIINEP

SEQ ID NO: 973 - protein, 15 aa, Phleum pratense
VLRIINEPTAAAIAY

SEQ ID NO: 974 - protein, 15 aa, Phleum pratense
GRYFSKDAVQIITKM

SEQ ID NO: 975 - protein, 15 aa, Phleum pratense
DAVQIITKMAAANGV

SEQ ID NO: 976 - protein, 15 aa, Phleum pratense
GVRRVWVGQDSLLST

SEQ ID NO: 977 - protein, 15 aa, Phleum pratense
SLLSTPAVSAIIRER

SEQ ID NO: 978 - protein, 15 aa, Phleum pratense
AVSAIIRERIAADGS

SEQ ID NO: 979 - protein, 15 aa, Phleum pratense
YPHMLLILLLLHGAN

SEQ ID NO: 980 - protein, 15 aa, Phleum pratense
ILLLLHGANAALDEP

SEQ ID NO: 981 - protein, 15 aa, Phleum pratense
ESSLYAYQFAMSNGL

SEQ ID NO: 982 - protein, 15 aa, Phleum pratense
SGLRLDKSTLIAEVF

SEQ ID NO: 983 - protein, 15 aa, Phleum pratense
IHGWFAVDFTAAELV

SEQ ID NO: 984 - protein, 15 aa, Phleum pratense
IGKRFASINVENVED

SEQ ID NO: 985 - protein, 15 aa, Phleum pratense
ALRELLFTTPGALQH

SEQ ID NO: 986 - protein, 15 aa, Phleum pratense
LQHISGVILFEETLY

SEQ ID NO: 987 - protein, 15 aa, Phleum pratense
YEAGARFAKWRAVLK

SEQ ID NO: 988 - protein, 15 aa, Phleum pratense
GLARYAIICQENGLV

SEQ ID NO: 989 - protein, 15 aa, Phleum pratense
RCAYVTEVVLAACYK

SEQ ID NO: 990 - protein, 15 aa, Phleum pratense
NDQHVLLEGSLLKPN

SEQ ID NO: 991 - protein, 15 aa, Phleum pratense
WFLSFSFGRALQQST

SEQ ID NO: 992 - protein, 15 aa, Phleum pratense
SVGFVETLENDLAQL

SEQ ID NO: 993 - protein, 15 aa, Phleum pratense
LGEAPYKFKSALEAV

SEQ ID NO: 994 - protein, 15 aa, Phleum pratense
KFKSALEAVKTLRAE

SEQ ID NO: 995 - protein, 15 aa, Phleum pratense
QYLPAFVIVDESGKS

SEQ ID NO: 996 - protein, 15 aa, Phleum pratense
VVTFNFRADRMVMLA

SEQ ID NO: 997 - protein, 15 aa, Phleum pratense
ADRMVMLAKALEFAD

SEQ ID NO: 998 - protein, 15 aa, Phleum pratense
FDKFDRVRVPKIKYA

SEQ ID NO: 999 - protein, 15 aa, Phleum pratense
PKIKYAGMLQYDGEL

SEQ ID NO: 1000 - protein, 15 aa, Phleum pratense
LKLPNKFLVSPPLIE

SEQ ID NO: 1001 - protein, 15 aa, Phleum pratense
GILLDFVWYEPLTYN

SEQ ID NO: 1002 - protein, 15 aa, Phleum pratense
ETMQRLVADRLPNFT

SEQ ID NO: 1003 - protein, 15 aa, Phleum pratense
GYSKWLYVVPWGFYK

SEQ ID NO: 1004 - protein, 15 aa, Phleum pratense
YVVPWGFYKAVMHVK

SEQ ID NO: 1005 - protein, 15 aa, Phleum pratense
KFRIDYFDQYLHELK

SEQ ID NO: 1006 - protein, 15 aa, Phleum pratense
ARVTGYFAWSLLDNF

SEQ ID NO: 1007 - protein, 15 aa, Phleum pratense
FAWSLLDNFEWRMGF

SEQ ID NO: 1008 - protein, 15 aa, Phleum pratense
EIPTISYSDLYQLAG

SEQ ID NO: 1009 - protein, 15 aa, Phleum pratense
YSDLYQLAGVVAVEV

SEQ ID NO: 1010 - protein, 15 aa, Phleum pratense
DHLRQVFGKQMGLSD

SEQ ID NO: 1011 - protein, 15 aa, Phleum pratense
KNPLKFDNTYFTELL

SEQ ID NO: 1012 - protein, 15 aa, Phleum pratense
KAFFEDYKEAHLRLS

SEQ ID NO: 1013 - protein, 15 aa, Phleum pratense
YKLLCSSFPVITYHQ

SEQ ID NO: 1014 - protein, 15 aa, Phleum pratense
FPVITYHQGRNGNLS

SEQ ID NO: 1015 - protein, 15 aa, Phleum pratense
RNGNLSALACPLNQK

SEQ ID NO: 1016 - protein, 15 aa, Phleum pratense
IPPAPHLKRWNRVVD

SEQ ID NO: 1017 - protein, 15 aa, Phleum pratense
LKRWNRVVDTNLESP

SEQ ID NO: 1018 - protein, 15 aa, Phleum pratense
VVDTNLESPNDIVPE

SEQ ID NO: 1019 - protein, 15 aa, Phleum pratense
GAPFTGSGYRIAPYS

SEQ ID NO: 1020 - protein, 15 aa, Phleum pratense
GYRIAPYSSILLKAT

SEQ ID NO: 1021 - protein, 15 aa, Phleum pratense
ECILSGLLSVDGLKV

SEQ ID NO: 1022 - protein, 15 aa, Phleum pratense
LLSVDGLKVLHMDRN

SEQ ID NO: 1023 - protein, 15 aa, Phleum pratense
VPKFMMANGALVRVL

SEQ ID NO: 1024 - protein, 15 aa, Phleum pratense
VRVLIRTSVTKYLNF

SEQ ID NO: 1025 - protein, 15 aa, Phleum pratense
TKYLNFKAVDGSFVY

SEQ ID NO: 1026 - protein, 15 aa, Phleum pratense
TDVEALKSNLMGLFE

SEQ ID NO: 1027 - protein, 15 aa, Phleum pratense
EKRRARKFFIYVQDY

SEQ ID NO: 1028 - protein, 15 aa, Phleum pratense
KFFIYVQDYEEEDPK

SEQ ID NO: 1029 - protein, 15 aa, Phleum pratense
TVDFIGHALALHRDD

SEQ ID NO: 1030 - protein, 15 aa, Phleum pratense
VKRMKLYAESLARFQ

SEQ ID NO: 1031 - protein, 15 aa, Phleum pratense
GELPQAFARLSAVYG

SEQ ID NO: 1032 - protein, 15 aa, Phleum pratense
FARLSAVYGGTYMLN

SEQ ID NO: 1033 - protein, 15 aa, Phleum pratense
KGKFIAFVSTEAETD

SEQ ID NO: 1034 - protein, 15 aa, Phleum pratense
ETTVKDVLALYSKIT

SEQ ID NO: 1035 - protein, 15 aa, Phleum pratense
LDLSVDLNAASAGES

SEQ ID NO: 1036 - protein, 15 aa, Phleum pratense
FKDDPYIYAFDSLKY

SEQ ID NO: 1037 - protein, 15 aa, Phleum pratense
AFDSLKYIGIELWQV

SEQ ID NO: 1038 - protein, 15 aa, Phleum pratense
IELWQVKSGTLFDNI

SEQ ID NO: 1039 - protein, 15 aa, Phleum pratense
GTLFDNILITDDAAL

SEQ ID NO: 1040 - protein, 15 aa, Phleum pratense
ILITDDAALAKTFAE

SEQ ID NO: 1041 - protein, 15 aa, Phleum pratense
KRPPRCCQDLVVLPL

SEQ ID NO: 1042 - protein, 15 aa, Phleum pratense
RGLLRRARGGPHHRR

SEQ ID NO: 1043 - protein, 15 aa, Phleum pratense
RGAHRRVPLRPLRHR

SEQ ID NO: 1044 - protein, 15 aa, Phleum pratense
EGRRAKLRSAGEVEI

SEQ ID NO: 1045 - protein, 15 aa, Phleum pratense
GEVEIQFRRVKCKYP

SEQ ID NO: 1046 - protein, 15 aa, Phleum pratense
TKVTFHVVGVGPLLH

SEQ ID NO: 1047 - protein, 15 aa, Phleum pratense
EDVAVSLAKYTAELS

SEQ ID NO: 1048 - protein, 15 aa, Phleum pratense
GKFAAERGAFTVVLS

SEQ ID NO: 1049 - protein, 15 aa, Phleum pratense
AFTVVLSGGTLIDTL

SEQ ID NO: 1050 - protein, 15 aa, Phleum pratense
DSNYKLAVDGLLSKV

SEQ ID NO: 1051 - protein, 15 aa, Phleum pratense
TVLKQLVKSGVLAMS

SEQ ID NO: 1052 - protein, 15 aa, Phleum pratense
KSGVLAMSTATGFPR

SEQ ID NO: 1053 - protein, 15 aa, Phleum pratense
PPPQRITFTFPVIKS

SEQ ID NO: 1054 - protein, 15 aa, Phleum pratense
TFTFPVIKSSAYVAM

SEQ ID NO: 1055 - protein, 15 aa, Phleum pratense
KTLPLLPTEMAILQD

SEQ ID NO: 1056 - protein, 15 aa, Phleum pratense
NKLIGARSFFESAKW

SEQ ID NO: 1057 - protein, 15 aa, Phleum pratense
RAHIAFYQVCFEQKG

SEQ ID NO: 1058 - protein, 15 aa, Phleum pratense
AALNGVFVSTAAGNI

SEQ ID NO: 1059 - protein, 15 aa, Phleum pratense
APWLLTVGASTSDRR

SEQ ID NO: 1060 - protein, 15 aa, Phleum pratense
STSDRRFAATVKLGS

SEQ ID NO: 1061 - protein, 15 aa, Phleum pratense
VLRAGAFGMIVVAPA

SEQ ID NO: 1062 - protein, 15 aa, Phleum pratense
FGMIVVAPAVFGPVI

SEQ ID NO: 1063 - protein, 15 aa, Phleum pratense
YAVGQKIKAYLEAES

SEQ ID NO: 1064 - protein, 15 aa, Phleum pratense
VPGVVDIVLQPKEVM

SEQ ID NO: 1065 - protein, 15 aa, Phleum pratense
CPHLAGIAALLKNAH

SEQ ID NO: 1066 - protein, 15 aa, Phleum pratense
GLVYNLTAAEYIPYL

SEQ ID NO: 1067 - protein, 15 aa, Phleum pratense
KADSVVNASRAVTNV

SEQ ID NO: 1068 - protein, 15 aa, Phleum pratense
KLTFKALEEVLNYTV

SEQ ID NO: 1069 - protein, 15 aa, Phleum pratense
EEVLNYTVTVKTAAV

SEQ ID NO: 1070 - protein, 15 aa, Phleum pratense
IEGQLKWVSSKHIVR

SEQ ID NO: 1071 - protein, 15 aa, Phleum pratense
WVSSKHIVRSPILIL

SEQ ID NO: 1072 - protein, 15 aa, Phleum pratense
SFRFFLAHSSIHPST

SEQ ID NO: 1073 - protein, 15 aa, Phleum pratense
EKHFKYVILGGGVAA

SEQ ID NO: 1074 - protein, 15 aa, Phleum pratense
TEKGIELILSTEIVK

SEQ ID NO: 1075 - protein, 15 aa, Phleum pratense
ASKTLTSAAGATFTY

SEQ ID NO: 1076 - protein, 15 aa, Phleum pratense
FTYETLLIATGSSTI

SEQ ID NO: 1077 - protein, 15 aa, Phleum pratense
GGGYIGLELSAALKL

SEQ ID NO: 1078 - protein, 15 aa, Phleum pratense
LELSAALKLNNFDVT

SEQ ID NO: 1079 - protein, 15 aa, Phleum pratense
LKLNNFDVTMVYPEP

SEQ ID NO: 1080 - protein, 15 aa, Phleum pratense
MPRLFTAGIAHFYEG

SEQ ID NO: 1081 - protein, 15 aa, Phleum pratense
HFYEGYYASKGINIV

SEQ ID NO: 1082 - protein, 15 aa, Phleum pratense
SKGINIVKGTVASGF

SEQ ID NO: 1083 - protein, 15 aa, Phleum pratense
DANIVIVGVGGRPLT

SEQ ID NO: 1084 - protein, 15 aa, Phleum pratense
KTDTFFETSVAGVYA

SEQ ID NO: 1085 - protein, 15 aa, Phleum pratense
VYAIGDVASFPMKLY

SEQ ID NO: 1086 - protein, 15 aa, Phleum pratense
DYLPYFYSRSFDIAW

SEQ ID NO: 1087 - protein, 15 aa, Phleum pratense
LLGYLLWVVAIRRPR

SEQ ID NO: 1088 - protein, 15 aa, Phleum pratense
WVVAIRRPRPVRCFS

SEQ ID NO: 1089 - protein, 15 aa, Phleum pratense
EQFVTPWSFSVASGH

SEQ ID NO: 1090 - protein, 15 aa, Phleum pratense
RDAHYLRGLLPPAIV

SEQ ID NO: 1091 - protein, 15 aa, Phleum pratense
MHNLRQYTVPLQRYI

SEQ ID NO: 1092 - protein, 15 aa, Phleum pratense
VPLQRYIAMMDLQER

SEQ ID NO: 1093 - protein, 15 aa, Phleum pratense
ERLFYKLLIDNVEEL

SEQ ID NO: 1094 - protein, 15 aa, Phleum pratense
EELLPVVYTPVVGEA

SEQ ID NO: 1095 - protein, 15 aa, Phleum pratense
RSIQVIVVTDGERIL

SEQ ID NO: 1096 - protein, 15 aa, Phleum pratense
EEYHELLQEFMNAVK

SEQ ID NO: 1097 - protein, 15 aa, Phleum pratense
GEKVLVQFEDFANHN

SEQ ID NO: 1098 - protein, 15 aa, Phleum pratense
FDLLAKYSKSHLVFN

SEQ ID NO: 1099 - protein, 15 aa, Phleum pratense
VFNDDIQGTASVVLA

SEQ ID NO: 1100 - protein, 15 aa, Phleum pratense
SVVLAGLLAALKVIG

SEQ ID NO: 1101 - protein, 15 aa, Phleum pratense
GLADQTYLFLGAGEA

SEQ ID NO: 1102 - protein, 15 aa, Phleum pratense
TGIAELIALEMSKHT

SEQ ID NO: 1103 - protein, 15 aa, Phleum pratense
CRKKIWLVDSKGLLV

SEQ ID NO: 1104 - protein, 15 aa, Phleum pratense
HEPLTTLLEAVQSLK

SEQ ID NO: 1105 - protein, 15 aa, Phleum pratense
LLEAVQSLKPTVLIG

SEQ ID NO: 1106 - protein, 15 aa, Phleum pratense
NEKPVIFSLSNPTSH

SEQ ID NO: 1107 - protein, 15 aa, Phleum pratense
EEAYTWTKGTAVFAS

SEQ ID NO: 1108 - protein, 15 aa, Phleum pratense
GFGLGVVISGAIRVH

SEQ ID NO: 1109 - protein, 15 aa, Phleum pratense
VISGAIRVHDDMLLA

SEQ ID NO: 1110 - protein, 15 aa, Phleum pratense
HDDMLLAASEALAEQ

SEQ ID NO: 1111 - protein, 15 aa, Phleum pratense
FPPFTNIRKISANIA

SEQ ID NO: 1112 - protein, 15 aa, Phleum pratense
IRKISANIAAKVAAK

SEQ ID NO: 1113 - protein, 15 aa, Phleum pratense
PRVNFFKRYNLTCVF

SEQ ID NO: 1114 - protein, 15 aa, Phleum pratense
KRYNLTCVFWSKKKK

SEQ ID NO: 1115 - protein, 15 aa, Phleum pratense
TIVASGIENMKIFTR

SEQ ID NO: 1116 - protein, 15 aa, Phleum pratense
FSCDSAYQVTYIVRG

SEQ ID NO: 1117 - protein, 15 aa, Phleum pratense
YQVTYIVRGSGRVQV

SEQ ID NO: 1118 - protein, 15 aa, Phleum pratense
IEGGSLFIVPRFHVV

SEQ ID NO: 1119 - protein, 15 aa, Phleum pratense
GMEWFSIITTPNPIF

SEQ ID NO: 1120 - protein, 15 aa, Phleum pratense
GKTSVWKAISPEVLE

SEQ ID NO: 1121 - protein, 15 aa, Phleum pratense
ELRKTYNLLDAVSRH

SEQ ID NO: 1122 - protein, 15 aa, Phleum pratense
QVYPRSWSAVMLTFD

SEQ ID NO: 1123 - protein, 15 aa, Phleum pratense
AVMLTFDNAGMWNVR

SEQ ID NO: 1124 - protein, 15 aa, Phleum pratense
NVWERHYLAGEMTLM

SEQ ID NO: 1125 - protein, 15 aa, Phleum pratense
GEQLYISVISPARSL

SEQ ID NO: 1126 - protein, 15 aa, Phleum pratense
DSSEYAFRTAVSSSM

SEQ ID NO: 1127 - protein, 15 aa, Phleum pratense
IGNLRLDNTTLIDKD

SEQ ID NO: 1128 - protein, 15 aa, Phleum pratense
EIPMIQNILSRSQIF

SEQ ID NO: 1129 - protein, 15 aa, Phleum pratense
SRSQIFDGIPNLMSL

SEQ ID NO: 1130 - protein, 15 aa, Phleum pratense
DGIPNLMSLDNVVKI

SEQ ID NO: 1131 - protein, 15 aa, Phleum pratense
IWVNVEYDSFYREHG

SEQ ID NO: 1132 - protein, 15 aa, Phleum pratense
EFPVTWVSSPEVALL

SEQ ID NO: 1133 - protein, 15 aa, Phleum pratense
SPEVALLKSLAGKLR

SEQ ID NO: 1134 - protein, 15 aa, Phleum pratense
AGKLRNSTKLIFRFL

SEQ ID NO: 1135 - protein, 15 aa, Phleum pratense
STKLIFRFLREDLVE

SEQ ID NO: 1136 - protein, 15 aa, Phleum pratense
GELLKDLKSIKAFAS

SEQ ID NO: 1137 - protein, 15 aa, Phleum pratense
LKSIKAFASGILVPK

SEQ ID NO: 1138 - protein, 15 aa, Phleum pratense
CEGILKLLETHLVPS

SEQ ID NO: 1139 - protein, 15 aa, Phleum pratense
LLETHLVPSSTAPES

SEQ ID NO: 1140 - protein, 15 aa, Phleum pratense
PESKVFYLKMKGDYH

SEQ ID NO: 1141 - protein, 15 aa, Phleum pratense
MNSYKAAQDIALADL

SEQ ID NO: 1142 - protein, 15 aa, Phleum pratense
APTHPIRLGLALKIS

SEQ ID NO: 1143 - protein, 15 aa, Phleum pratense
LLGLLAPLASAQLSR

SEQ ID NO: 1144 - protein, 15 aa, Phleum pratense
PDAEKIVAAVIEKKL

SEQ ID NO: 1145 - protein, 15 aa, Phleum pratense
AGLLRLLFHDCFANG

SEQ ID NO: 1146 - protein, 15 aa, Phleum pratense
CDASILIDPLSNQSA

SEQ ID NO: 1147 - protein, 15 aa, Phleum pratense
IDSSYFANVLAKKMP

SEQ ID NO: 1148 - protein, 15 aa, Phleum pratense
KPNDFMPTFAKAMEK

SEQ ID NO: 1149 - protein, 15 aa, Phleum pratense
PTFAKAMEKLSVLKV

SEQ ID NO: 1150 - protein, 15 aa, Phleum pratense
GGSVIRISSANPEDL

SEQ ID NO: 1151 - protein, 15 aa, Phleum pratense
DPWHVKTLKAAGAAH

SEQ ID NO: 1152 - protein, 15 aa, Phleum pratense
WSEIQTLKPNLIGPF

SEQ ID NO: 1153 - protein, 15 aa, Phleum pratense
KFMTLAGFLDYAKAS

SEQ ID NO: 1154 - protein, 15 aa, Phleum pratense
NISGILIGIEHAAYL

SEQ ID NO: 1155 - protein, 15 aa, Phleum pratense
AAYLATRGLDVVDAV

SEQ ID NO: 1156 - protein, 15 aa, Phleum pratense
GLDVVDAVSNALIKS

SEQ ID NO: 1157 - protein, 15 aa, Phleum pratense
TKQQVFIQSEDPPVL

SEQ ID NO: 1158 - protein, 15 aa, Phleum pratense
PVLSAFKKFPKFNRV

SEQ ID NO: 1159 - protein, 15 aa, Phleum pratense
KFPKFNRVFEIEFDI

SEQ ID NO: 1160 - protein, 15 aa, Phleum pratense
VEIKEFANAVKLRRS

SEQ ID NO: 1161 - protein, 15 aa, Phleum pratense
VKLRRSSAAQVDGFY

SEQ ID NO: 1162 - protein, 15 aa, Phleum pratense
GFYLTGFNAVVERLR

SEQ ID NO: 1163 - protein, 15 aa, Phleum pratense
GVLKNEFMSLAFDYW

SEQ ID NO: 1164 - protein, 15 aa, Phleum pratense
GLVTEFPSTAAAYFR

SEQ ID NO: 1165 - protein, 15 aa, Phleum pratense
NIVVNVFNQLDQPLL

SEQ ID NO: 1166 - protein, 15 aa, Phleum pratense
QPLLFTWNGIQHRKN

SEQ ID NO: 1167 - protein, 15 aa, Phleum pratense
IGSFFYFPSIGMQRT

SEQ ID NO: 1168 - protein, 15 aa, Phleum pratense
GYGLISVVSRLLIPV

SEQ ID NO: 1169 - protein, 15 aa, Phleum pratense
VVSRLLIPVPFDPPA

SEQ ID NO: 1170 - protein, 15 aa, Phleum pratense
VCTRLSPFCCLYCIL

SEQ ID NO: 1171 - protein, 15 aa, Phleum pratense
YCILCCWYSMRLVTV

SEQ ID NO: 1172 - protein, 15 aa, Phleum pratense
NIWADDLAASLSTLE

SEQ ID NO: 1173 - protein, 15 aa, Phleum pratense
IAIAFLSVSNNYEYI

SEQ ID NO: 1174 - protein, 15 aa, Phleum pratense
VSNNYEYILSDKLVV

SEQ ID NO: 1175 - protein, 15 aa, Phleum pratense
KDKLVVSTSCSLMHT

SEQ ID NO: 1176 - protein, 15 aa, Phleum pratense
TSCSLMHTAVDLVNE

SEQ ID NO: 1177 - protein, 15 aa, Phleum pratense
TKLDSEIKSWLAFAA

SEQ ID NO: 1178 - protein, 15 aa, Phleum pratense
IKSWLAFAAQKVVEV

SEQ ID NO: 1179 - protein, 15 aa, Phleum pratense
KVVEVNALGKALVGL

SEQ ID NO: 1180 - protein, 15 aa, Phleum pratense
LKDEAYFAANAAAQA

SEQ ID NO: 1181 - protein, 15 aa, Phleum pratense
EAYVSAIKEEISKVV

SEQ ID NO: 1182 - protein, 15 aa, Phleum pratense
ISKVVKIQEELDIDV

SEQ ID NO: 1183 - protein, 15 aa, Phleum pratense
MVEYFGEQLSGFAFT

SEQ ID NO: 1184 - protein, 15 aa, Phleum pratense
LSGFAFTANGWVQSY

SEQ ID NO: 1185 - protein, 15 aa, Phleum pratense
NPMTVFWSKMAQSMT

SEQ ID NO: 1186 - protein, 15 aa, Phleum pratense
EGPLMLYVSKMIPAS

SEQ ID NO: 1187 - protein, 15 aa, Phleum pratense
KGRFFAFGRVFAGRV

SEQ ID NO: 1188 - protein, 15 aa, Phleum pratense
GNTVALVGLDQFITK

SEQ ID NO: 1189 - protein, 15 aa, Phleum pratense
VGLDQFITKNATLTG

SEQ ID NO: 1190 - protein, 15 aa, Phleum pratense
PIRAMKFSVSPVVRV

SEQ ID NO: 1191 - protein, 15 aa, Phleum pratense
FMGGAEIIVSPPVVS

SEQ ID NO: 1192 - protein, 15 aa, Phleum pratense
SPPVVSFRETVLDKS

SEQ ID NO: 1193 - protein, 15 aa, Phleum pratense
NKHNRLYMEARPLEE

SEQ ID NO: 1194 - protein, 15 aa, Phleum pratense
PTARRVIFASQLTAK

SEQ ID NO: 1195 - protein, 15 aa, Phleum pratense
AKPRLLEPVYLVEIQ

SEQ ID NO: 1196 - protein, 15 aa, Phleum pratense
EPVYLVEIQAPEGAL

SEQ ID NO: 1197 - protein, 15 aa, Phleum pratense
PLYNIKAYLPVIESF

SEQ ID NO: 1198 - protein, 15 aa, Phleum pratense
LPVIESFGFSATLRA

SEQ ID NO: 1199 - protein, 15 aa, Phleum pratense
FGFSATLRAATSGQA

SEQ ID NO: 1200 - protein, 15 aa, Phleum pratense
SLKLHKACEAFNPYD

SEQ ID NO: 1201 - protein, 15 aa, Phleum pratense
EAFDPYYGKISLSKV

SEQ ID NO: 1202 - protein, 15 aa, Phleum pratense
SKVRSFLTEAKAKHI

SEQ ID NO: 1203 - protein, 15 aa, Phleum pratense
LTEAKAKHIEWNCDV

SEQ ID NO: 1204 - protein, 15 aa, Phleum pratense
KEKRWNAALTSISAS

SEQ ID NO: 1205 - protein, 15 aa, Phleum pratense
GSAYVDLGSLLAERT

SEQ ID NO: 1206 - protein, 15 aa, Phleum pratense
RHLARQFIPHLHQRF

SEQ ID NO: 1207 - protein, 15 aa, Phleum pratense
FIPHLHQRFIHPPIH

SEQ ID NO: 1208 - protein, 15 aa, Phleum pratense
NTMENLSSTIFSFVI

SEQ ID NO: 1209 - protein, 15 aa, Phleum pratense
TIFSFVILLSASASL

SEQ ID NO: 1210 - protein, 15 aa, Phleum pratense
ILLSASASLVVAGDP

SEQ ID NO: 1211 - protein, 15 aa, Phleum pratense
ELAEMEVSAAFHLFS

SEQ ID NO: 1212 - protein, 15 aa, Phleum pratense
SAAFHLFSMAVTAAR

SEQ ID NO: 1213 - protein, 15 aa, Phleum pratense
FSMAVTAARSQQWND

SEQ ID NO: 1214 - protein, 15 aa, Phleum pratense
KISLSKVRSFLTEAK

SEQ ID NO: 1215 - protein, 15 aa, Phleum pratense
QQYTAALSPILFECL

SEQ ID NO: 1216 - protein, 15 aa, Phleum pratense
LSPILFECLIHPMLG

SEQ ID NO: 1217 - protein, 15 aa, Phleum pratense
VEDNLVKLKNVLNVY

SEQ ID NO: 1218 - protein, 15 aa, Phleum pratense
KLKNVLNVYEARLTK

SEQ ID NO: 1219 - protein, 15 aa, Phleum pratense
EVYEARLTKFKYLAG

SEQ ID NO: 1220 - protein, 15 aa, Phleum pratense
TKFKYLAGDYLSLAD

SEQ ID NO: 1221 - protein, 15 aa, Phleum pratense
AGDYLSLADLNHVST

SEQ ID NO: 1222 - protein, 15 aa, Phleum pratense
VKAWWTDLLAKPSVQ

SEQ ID NO: 1223 - protein, 15 aa, Phleum pratense
KLRFTCLSSTGSSCL

SEQ ID NO: 1224 - protein, 15 aa, Phleum pratense
LSSTGSSCLFVLILF

SEQ ID NO: 1225 - protein, 15 aa, Phleum pratense
EKLKKVLEVYEARLS

SEQ ID NO: 1226 - protein, 15 aa, Phleum pratense
SYLAGDFVSFADLNH

SEQ ID NO: 1227 - protein, 15 aa, Phleum pratense
FVSFADLNHFPKTFY

SEQ ID NO: 1228 - protein, 15 aa, Phleum pratense
FPKTFYFMATPHASL

SEQ ID NO: 1229 - protein, 15 aa, Phleum pratense
HVKAWWERIMARPAV

SEQ ID NO: 1230 - protein, 15 aa, Phleum pratense
IMARPAVKKIAAAMV

SEQ ID NO: 1231 - protein, 15 aa, Phleum pratense
KRKVRGFWRVHQISA

SEQ ID NO: 1232 - protein, 15 aa, Phleum pratense
FWRVHQISARMAPVK

SEQ ID NO: 1233 - protein, 15 aa, Phleum pratense
MAPVKLYGATLSWNV

SEQ ID NO: 1234 - protein, 15 aa, Phleum pratense
GDLYIFESRAICKYA

SEQ ID NO: 1235 - protein, 15 aa, Phleum pratense
EANQYTAALGPILFE

SEQ ID NO: 1236 - protein, 15 aa, Phleum pratense
ACSLFLNYAVSFNYF

SEQ ID NO: 1237 - protein, 15 aa, Phleum pratense
YAVSFNYFVCNLLQE

SEQ ID NO: 1238 - protein, 15 aa, Phleum pratense
NLLQERLKKLKSEHG

SEQ ID NO: 1239 - protein, 15 aa, Phleum pratense
GMTGMLWETSLLDPE

SEQ ID NO: 1240 - protein, 15 aa, Phleum pratense
PEGLLWLLLTGKVPT

SEQ ID NO: 1241 - protein, 15 aa, Phleum pratense
YVYKAIDALPVTAHP

SEQ ID NO: 1242 - protein, 15 aa, Phleum pratense
QFTTGVMALQVESEF

SEQ ID NO: 1243 - protein, 15 aa, Phleum pratense
EDCLNLIARLPQVAS

SEQ ID NO: 1244 - protein, 15 aa, Phleum pratense
IARLPQVASYVYRRI

SEQ ID NO: 1245 - protein, 15 aa, Phleum pratense
ADNSLDYAANFSHML

SEQ ID NO: 1246 - protein, 15 aa, Phleum pratense
DPKMLELMRLYITIH

SEQ ID NO: 1247 - protein, 15 aa, Phleum pratense
ALSDPYLSFAAALNG

SEQ ID NO: 1248 - protein, 15 aa, Phleum pratense
LSFAAALNGLAGPLH

SEQ ID NO: 1249 - protein, 15 aa, Phleum pratense
PLHGLANQEVLLWIK

SEQ ID NO: 1250 - protein, 15 aa, Phleum pratense
QEVLLWIKSVMEETG

SEQ ID NO: 1251 - protein, 15 aa, Phleum pratense
QLKEYVWKTLKSGKV

SEQ ID NO: 1252 - protein, 15 aa, Phleum pratense
EDPLFQLVSKLYEVV

SEQ ID NO: 1253 - protein, 15 aa, Phleum pratense
LVSKLYEVVPGILTE

SEQ ID NO: 1254 - protein, 15 aa, Phleum pratense
SGVLLNHFGLVEARY

SEQ ID NO: 1255 - protein, 15 aa, Phleum pratense
TVLFGVSRSMGIGSQ

SEQ ID NO: 1256 - protein, 15 aa, Phleum pratense
GSQLIWDRALGLPLE

SEQ ID NO: 1257 - protein, 15 aa, Phleum pratense
GPVTILNWSFVRNDQ

SEQ ID NO: 1258 - protein, 15 aa, Phleum pratense
PRFETCYQIALAIKK

SEQ ID NO: 1259 - protein, 15 aa, Phleum pratense
GIQVIQIDEAALREG

SEQ ID NO: 1260 - protein, 15 aa, Phleum pratense
EHAFYLDWAVHSFRI

SEQ ID NO: 1261 - protein, 15 aa, Phleum pratense
FNDIIHSIINMDADV

SEQ ID NO: 1262 - protein, 15 aa, Phleum pratense
SDEKLLSVFREGVTY

SEQ ID NO: 1263 - protein, 15 aa, Phleum pratense
VNKMLAVLDTNILWV

SEQ ID NO: 1264 - protein, 15 aa, Phleum pratense
TRKYAEVMPALTNMV

SEQ ID NO: 1265 - protein, 15 aa, Phleum pratense
PALTNMVTAAKLIRT

SEQ ID NO: 1266 - protein, 15 aa, Phleum pratense
VTAAKLIRTQLASTK

SEQ ID NO: 1267 - protein, 15 aa, Phleum pratense
GRGIKDEGLVVAPGQ

SEQ ID NO: 1268 - protein, 15 aa, Phleum pratense
LTVGNIIAGDRFSMA

SEQ ID NO: 1269 - protein, 15 aa, Phleum pratense
DRFSMAYDRTPEEIL

SEQ ID NO: 1270 - protein, 15 aa, Phleum pratense
YDRTPEEILAIVYGT

SEQ ID NO: 1271 - protein, 15 aa, Phleum pratense
EILAIVYGTGNPAQA

SEQ ID NO: 1272 - protein, 15 aa, Phleum pratense
TREENVYMAKLAEQA

SEQ ID NO: 1273 - protein, 15 aa, Phleum pratense
YEEMVEFMEKVAKTA

SEQ ID NO: 1274 - protein, 15 aa, Phleum pratense
EERNLLSVAYKNVIG

SEQ ID NO: 1275 - protein, 15 aa, Phleum pratense
AYKNVIGARRASWRI

SEQ ID NO: 1276 - protein, 15 aa, Phleum pratense
RRASWRIISSIEQKE

SEQ ID NO: 1277 - protein, 15 aa, Phleum pratense
NEAYVASIKEYRTRI

SEQ ID NO: 1278 - protein, 15 aa, Phleum pratense
SKICDGILKLLDSHL

SEQ ID NO: 1279 - protein, 15 aa, Phleum pratense
ILKLLDSHLVPSATA

SEQ ID NO: 1280 - protein, 15 aa, Phleum pratense
AESKVFYLKMKGDYH

SEQ ID NO: 1281 - protein, 15 aa, Phleum pratense
GDYHRYLAEFKAGAE

SEQ ID NO: 1282 - protein, 15 aa, Phleum pratense
NTLVAYKSAQDIALA

SEQ ID NO: 1283 - protein, 15 aa, Phleum pratense
LPTTHPIRLGLALNF

SEQ ID NO: 1284 - protein, 15 aa, Phleum pratense
IRLGLALNFSVFYYE

SEQ ID NO: 1285 - protein, 15 aa, Phleum pratense
LNFSVFYYEILNSPD

SEQ ID NO: 1286 - protein, 15 aa, Phleum pratense
YKDSTLIMQLLRDNL

SEQ ID NO: 1287 - protein, 15 aa, Phleum pratense
IMQLLRDNLTLWTSD

SEQ ID NO: 1288 - protein, 15 aa, Phleum pratense
GSRALPFLLQLTKQP

SEQ ID NO: 1289 - protein, 15 aa, Phleum pratense
VKVYVVYYSMYGHVG

SEQ ID NO: 1290 - protein, 15 aa, Phleum pratense
GVEVKVWQVPEILSE

SEQ ID NO: 1291 - protein, 15 aa, Phleum pratense
ADGILFGFPTRFGMM

SEQ ID NO: 1292 - protein, 15 aa, Phleum pratense
FHQGKYFAGIAKKLK

SEQ ID NO: 1293 - protein, 15 aa, Phleum pratense
DVYPTVCLPMCVCVL

SEQ ID NO: 1294 - protein, 15 aa, Phleum pratense
EPAYFATAESVRDHL

SEQ ID NO: 1295 - protein, 15 aa, Phleum pratense
QTYYLSMEYLQGRAL

SEQ ID NO: 1296 - protein, 15 aa, Phleum pratense
AVGNLGITGAYAEAV

SEQ ID NO: 1297 - protein, 15 aa, Phleum pratense
AEAVKKFGYELEALA

SEQ ID NO: 1298 - protein, 15 aa, Phleum pratense
RLAACFLDSMATLNL

SEQ ID NO: 1299 - protein, 15 aa, Phleum pratense
LRYRYGLFKQRIAKE

SEQ ID NO: 1300 - protein, 15 aa, Phleum pratense
FSPWEIVRHDVVYPV

SEQ ID NO: 1301 - protein, 15 aa, Phleum pratense
VYPVRFFGHVEILPD

SEQ ID NO: 1302 - protein, 15 aa, Phleum pratense
GEVLNALAYDVPIPG

SEQ ID NO: 1303 - protein, 15 aa, Phleum pratense
IPGYKTKNAISLRLW

SEQ ID NO: 1304 - protein, 15 aa, Phleum pratense
AEDFNLFQFNDGQYE

SEQ ID NO: 1305 - protein, 15 aa, Phleum pratense
EGKLLRLKQQFFLCS

SEQ ID NO: 1306 - protein, 15 aa, Phleum pratense
LKQQFFLCSASLQDI

SEQ ID NO: 1307 - protein, 15 aa, Phleum pratense
PTLAIPELMRLLMDE

SEQ ID NO: 1308 - protein, 15 aa, Phleum pratense
QSVMRKLLPRQMEII

SEQ ID NO: 1309 - protein, 15 aa, Phleum pratense
EEIDKRFREMVISTR

SEQ ID NO: 1310 - protein, 15 aa, Phleum pratense
PQKPVVRMANLCVVS

SEQ ID NO: 1311 - protein, 15 aa, Phleum pratense
ILKEELFADYVSIWP

SEQ ID NO: 1312 - protein, 15 aa, Phleum pratense
PRRWLRFCNPELSEI

SEQ ID NO: 1313 - protein, 15 aa, Phleum pratense
EKLHAEWAAAKLASK

SEQ ID NO: 1314 - protein, 15 aa, Phleum pratense
IKRIHEYKRQLMNIL

SEQ ID NO: 1315 - protein, 15 aa, Phleum pratense
YKRQLMNILGAVYRY

SEQ ID NO: 1316 - protein, 15 aa, Phleum pratense
LGAVYRYKKLKEMSA

SEQ ID NO: 1317 - protein, 15 aa, Phleum pratense
GKAFATYTNAKRIVK

SEQ ID NO: 1318 - protein, 15 aa, Phleum pratense
KRIVKLVNDVGAVVN

SEQ ID NO: 1319 - protein, 15 aa, Phleum pratense
VNKYLKVVFIPNYNV

SEQ ID NO: 1320 - protein, 15 aa, Phleum pratense
VFIPNYNVSVAEVLI

SEQ ID NO: 1321 - protein, 15 aa, Phleum pratense
EDNFFLFGAKADQVA

SEQ ID NO: 1322 - protein, 15 aa, Phleum pratense
TFGTYDYTPLLDSLE

SEQ ID NO: 1323 - protein, 15 aa, Phleum pratense
FLVGYDFPSYIDAQA

SEQ ID NO: 1324 - protein, 15 aa, Phleum pratense
KRWIKMSILNTAGSG

SEQ ID NO: 1325 - protein, 15 aa, Phleum pratense
QYAKEIWGITANPVP

SEQ ID NO: 1326 - protein, 15 aa, Phleum pratense
KTLAVALGGARPLAT

SEQ ID NO: 1327 - protein, 15 aa, Phleum pratense
LATRGVATFTLPDLP

SEQ ID NO: 1328 - protein, 15 aa, Phleum pratense
PDLPYDYGALEPAIS

SEQ ID NO: 1329 - protein, 15 aa, Phleum pratense
HATYVANYNKALEQL

SEQ ID NO: 1330 - protein, 15 aa, Phleum pratense
GDASAVVQLQGAIKF

SEQ ID NO: 1331 - protein, 15 aa, Phleum pratense
DPLVTKGANLIPLLG

SEQ ID NO: 1332 - protein, 15 aa, Phleum pratense
ANLIPLLGIDVWEHA

SEQ ID NO: 1333 - protein, 15 aa, Phleum pratense
HAYYLQYKNVRPDYL

SEQ ID NO: 1334 - protein, 15 aa, Phleum pratense
PDYLTNIWKVVNWKY

SEQ ID NO: 1335 - protein, 15 aa, Phleum pratense
APSGRIVMELYADVV

SEQ ID NO: 1336 - protein, 15 aa, Phleum pratense
VMELYADVVPKTAEN

SEQ ID NO: 1337 - protein, 15 aa, Phleum pratense
HYKGSSFHRVIPGFM

SEQ ID NO: 1338 - protein, 15 aa, Phleum pratense
SIYGAKFADENFIKK

SEQ ID NO: 1339 - protein, 15 aa, Phleum pratense
NGSQFFLCTAKTAWL

SEQ ID NO: 1340 - protein, 15 aa, Phleum pratense
SQVHIRRPGGAGRDG

SEQ ID NO: 1341 - protein, 15 aa, Phleum pratense
RPGGAGRDGGQLRIP

SEQ ID NO: 1342 - protein, 15 aa, Phleum pratense
RDGGQLRIPSLLHGG

SEQ ID NO: 1343 - protein, 15 aa, Phleum pratense
GHGCAQPAMERRKHI

SEQ ID NO: 1344 - protein, 15 aa, Phleum pratense
RKHIEWNCDVCRHGD

SEQ ID NO: 1345 - protein, 15 aa, Phleum pratense
WTTVMRASCGHHRFR

SEQ ID NO: 1346 - protein, 15 aa, Phleum pratense
RFRDCVISSLADFKL

SEQ ID NO: 1347 - protein, 15 aa, Phleum pratense
ISSLADFKLFPVLQH

SEQ ID NO: 1348 - protein, 15 aa, Phleum pratense
PVLQHIISIAVLAIF

SEQ ID NO: 1349 - protein, 15 aa, Phleum pratense
ISIAVLAIFIGLLMI

SEQ ID NO: 1350 - protein, 15 aa, Phleum pratense
DEKLLSVFREGVVYG

SEQ ID NO: 1351 - protein, 15 aa, Phleum pratense
GPGVYDIHSPRIPSK

SEQ ID NO: 1352 - protein, 15 aa, Phleum pratense
EEIADDFALFRGTRP

SEQ ID NO: 1353 - protein, 15 aa, Phleum pratense
FALFRGTRPPRRPKK

SEQ ID NO: 1354 - protein, 15 aa, Phleum pratense
LCPGFCLADVTPETY

SEQ ID NO: 1355 - protein, 15 aa, Phleum pratense
SCRGRCPCSLRTPAW

SEQ ID NO: 1356 - protein, 15 aa, Phleum pratense
SLRTPAWGSCSRMAP

SEQ ID NO: 1357 - protein, 15 aa, Phleum pratense
WGSCSRMAPCNCRCP

SEQ ID NO: 1358 - protein, 15 aa, Phleum pratense
NCRCPCSTRGARRRL

SEQ ID NO: 1359 - protein, 15 aa, Phleum pratense
STRGARRRLPGRTSS

SEQ ID NO: 1360 - protein, 15 aa, Phleum pratense
PWRPPRRWSCCPLPW

SEQ ID NO: 1361 - protein, 15 aa, Phleum pratense
SCCPLPWPGTRRWWF

SEQ ID NO: 1362 - protein, 15 aa, Phleum pratense
GTRRWWFRCHQPPSS

SEQ ID NO: 1363 - protein, 15 aa, Phleum pratense
FRCHQPPSSRTAPGS

SEQ ID NO: 1364 - protein, 15 aa, Phleum pratense
PGSSRSLYGSPSTSC

SEQ ID NO: 1365 - protein, 15 aa, Phleum pratense
KHLIYVTGWSVYTEI

SEQ ID NO: 1366 - protein, 15 aa, Phleum pratense
TGWSVYTEITLLRDA

SEQ ID NO: 1367 - protein, 15 aa, Phleum pratense
SEGVRVLMLVWDDRT

SEQ ID NO: 1368 - protein, 15 aa, Phleum pratense
DDSGSIVQDLQISTM

SEQ ID NO: 1369 - protein, 15 aa, Phleum pratense
LQISTMFTHHQKIVV

SEQ ID NO: 1370 - protein, 15 aa, Phleum pratense
RRRRIMSFVGGLDLC

SEQ ID NO: 1371 - protein, 15 aa, Phleum pratense
PVAWDVLYNFEQRWR

SEQ ID NO: 1372 - protein, 15 aa, Phleum pratense
GKDLLIQLRDLADEI

SEQ ID NO: 1373 - protein, 15 aa, Phleum pratense
AWNVQLFRSIDGGAA

SEQ ID NO: 1374 - protein, 15 aa, Phleum pratense
DAYICAIRRAKSFIY

SEQ ID NO: 1375 - protein, 15 aa, Phleum pratense
IRRAKSFIYIENQYF

SEQ ID NO: 1376 - protein, 15 aa, Phleum pratense
FIYIENQYFLGSSYC

SEQ ID NO: 1377 - protein, 15 aa, Phleum pratense
RFTVYVVVPMWPEGI

SEQ ID NO: 1378 - protein, 15 aa, Phleum pratense
RRTMEMMYTDIAQAI

SEQ ID NO: 1379 - protein, 15 aa, Phleum pratense
MYTDIAQAIQAKGID

SEQ ID NO: 1380 - protein, 15 aa, Phleum pratense
DYLKAQQNRRFMIYV

SEQ ID NO: 1381 - protein, 15 aa, Phleum pratense
FMIYVHTKMMIVDDE

SEQ ID NO: 1382 - protein, 15 aa, Phleum pratense
IVDDEYIIVGSANIN

SEQ ID NO: 1383 - protein, 15 aa, Phleum pratense
YQPYHLAASRPARGQ

SEQ ID NO: 1384 - protein, 15 aa, Phleum pratense
GQVHGFRMALWYEHL

SEQ ID NO: 1385 - protein, 15 aa, Phleum pratense
RMALWYEHLGMVDEA

SEQ ID NO: 1386 - protein, 15 aa, Phleum pratense
CVRKVNAMADRYWNL

SEQ ID NO: 1387 - protein, 15 aa, Phleum pratense
LPGVEFFPDTQARIL

SEQ ID NO: 1388 - protein, 15 aa, Phleum pratense
TAPTSRRSPSAPSPH

SEQ ID NO: 1389 - protein, 15 aa, Phleum pratense
TRTCISTRRIPSRPT

SEQ ID NO: 1390 - protein, 15 aa, Phleum pratense
PWSTCRAARSPTPSA

SEQ ID NO: 1391 - protein, 15 aa, Phleum pratense
DRREIWLSEMVAWVG

SEQ ID NO: 1392 - protein, 15 aa, Phleum pratense
SEMVAWVGLQLAFWI

SEQ ID NO: 1393 - protein, 15 aa, Phleum pratense
VKVAPAALVNVLEAR

SEQ ID NO: 1394 - protein, 15 aa, Phleum pratense
LVNVLEARSALTISV

SEQ ID NO: 1395 - protein, 15 aa, Phleum pratense
ARSALTISVLRISSM

SEQ ID NO: 1396 - protein, 15 aa, Phleum pratense
ISVLRISSMPFSVYH

SEQ ID NO: 1397 - protein, 15 aa, Phleum pratense
LAAFWGKRYPLLSAG

SEQ ID NO: 1398 - protein, 15 aa, Phleum pratense
SSPSCAPESTHAVRA

SEQ ID NO: 1399 - protein, 15 aa, Phleum pratense
PESTHAVRALPSTHT

SEQ ID NO: 1400 - protein, 15 aa, Phleum pratense
VRALPSTHTARILLR

SEQ ID NO: 1401 - protein, 15 aa, Phleum pratense
THTARILLRSTTANV

SEQ ID NO: 1402 - protein, 15 aa, Phleum pratense
LLRSTTANVSGCKDR

SEQ ID NO: 1403 - protein, 15 aa, Phleum pratense
VQVPGGHQGDLPRGE

SEQ ID NO: 1404 - protein, 15 aa, Phleum pratense
LPGAAGEVCRRRRRR

SEQ ID NO: 1405 - protein, 15 aa, Phleum pratense
GQGQVDRAQGVVGSH

SEQ ID NO: 1406 - protein, 15 aa, Phleum pratense
GVVGSHLEDRHSRQA

SEQ ID NO: 1407 - protein, 15 aa, Phleum pratense
LEDRHSRQAHRPLHR

SEQ ID NO: 1408 - protein, 15 aa, Phleum pratense
HTFKSLFESWPVSST

SEQ ID NO: 1409 - protein, 15 aa, Phleum pratense
DCYIVLYTYHSGEKR

SEQ ID NO: 1410 - protein, 15 aa, Phleum pratense
FYLTYWIGKDSVLED

SEQ ID NO: 1411 - protein, 15 aa, Phleum pratense
QHMALQIATTIWNSM

SEQ ID NO: 1412 - protein, 15 aa, Phleum pratense
EPPQFIALFQPMVIL

SEQ ID NO: 1413 - protein, 15 aa, Phleum pratense
KDETYSGTGIALVHI

SEQ ID NO: 1414 - protein, 15 aa, Phleum pratense
GTGIALVHIHGTSIH

SEQ ID NO: 1415 - protein, 15 aa, Phleum pratense
NNKTLQVDAVSISLS

SEQ ID NO: 1416 - protein, 15 aa, Phleum pratense
TDCFVLQSGNSMFTW

SEQ ID NO: 1417 - protein, 15 aa, Phleum pratense
QQQWAAKVAEFLKPG

SEQ ID NO: 1418 - protein, 15 aa, Phleum pratense
DVLREPHLYTFSFRN

SEQ ID NO: 1419 - protein, 15 aa, Phleum pratense
LEVTEVFNFSQDDLL

SEQ ID NO: 1420 - protein, 15 aa, Phleum pratense
FNFSQDDLLTEDVMI

SEQ ID NO: 1421 - protein, 15 aa, Phleum pratense
DVMILDTHAEVFVWM

SEQ ID NO: 1422 - protein, 15 aa, Phleum pratense
CFFRTYFSWDNTRSV

SEQ ID NO: 1423 - protein, 15 aa, Phleum pratense
NSFQKKLSLLFGMRS

SEQ ID NO: 1424 - protein, 15 aa, Phleum pratense
RASALAALSSAFNPS

SEQ ID NO: 1425 - protein, 15 aa, Phleum pratense
QRASALAALSSSLNP

SEQ ID NO: 1426 - protein, 15 aa, Phleum pratense
SQRAAAVAALSNVLT

SEQ ID NO: 1427 - protein, 15 aa, Phleum pratense
VAALSNVLTAEGSTL

SEQ ID NO: 1428 - protein, 15 aa, Phleum pratense
ETTFSYDRLISKSTD

SEQ ID NO: 1429 - protein, 15 aa, Phleum pratense
YKRRETYLSDSEFET

SEQ ID NO: 1430 - protein, 15 aa, Phleum pratense
SEFETVFGVTKEEFY

SEQ ID NO: 1431 - protein, 15 aa, Phleum pratense
SRSFLKHSLLRTQRL

SEQ ID NO: 1432 - protein, 15 aa, Phleum pratense
HSLLRTQRLHKFLVC

SEQ ID NO: 1433 - protein, 15 aa, Phleum pratense
LHKFLVCSSMIGVMA

SEQ ID NO: 1434 - protein, 15 aa, Phleum pratense
SGNLVMFQMQDHQLI

SEQ ID NO: 1435 - protein, 15 aa, Phleum pratense
QLIYPLISPSFLVYS

SEQ ID NO: 1436 - protein, 15 aa, Phleum pratense
ISPSFLVYSFFVHDL

SEQ ID NO: 1437 - protein, 15 aa, Phleum pratense
ERLIYQTANSRLCSV

SEQ ID NO: 1438 - protein, 15 aa, Phleum pratense
ANSRLCSVLPKEEFY

SEQ ID NO: 1439 - protein, 15 aa, Phleum pratense
VLPKEEFYQQPRWKQ

SEQ ID NO: 1440 - protein, 15 aa, Phleum pratense
FYQQPRWKQELQKRK

SEQ ID NO: 1441 - protein, 15 aa, Phleum pratense
TGAAAAMTTTIRSTA

SEQ ID NO: 1442 - protein, 15 aa, Phleum pratense
TTIRSTATARPRAIV

What is claimed is:

1. A method for increasing immunological tolerance against grass pollen in a subject, the method comprising administering at least once to a subject an effective amount of a peptide comprising at least one T-cell epitope, said peptide consisting of
    a) an amino acid sequence selected from the group consisting of SEQ ID NOS: 854, 855, and 857-868
    wherein said peptide induces, elicits or stimulates production of interleukin-5 or interferon-gamma production in peripheral blood mononuclear cells from grass allergic subjects following contact with said peptide.

2. The method of claim 1, wherein said production of interleukin-5 or interferon-gamma in peripheral blood mononuclear cells treats grass pollen allergy in a subject having a grass pollen allergy.

3. The method according to claim 1, wherein the peptide further elicits, stimulates, promotes, induces or enhances a T cell response following administration to said subject.

4. A method for increasing immunological tolerance against grass pollen in a subject, the method comprising administering at least once to a subject an effective amount of a protein consisting of:
    a) an amino acid sequence selected from the group consisting of SEQ ID NOS:177-186
    wherein said protein induces, elicits or stimulates production of interleukin-5 or interferon-gamma production in peripheral blood mononuclear cells from grass allergic subjects following contact with said protein.

5. The method of claim 4, wherein said production of interleukin-5 or interferon-gamma in peripheral blood mononuclear cells treats grass pollen allergy in a subject having grass pollen allergy.

* * * * *